US006537751B1

(12) United States Patent
Cohen et al.

(10) Patent No.: US 6,537,751 B1
(45) Date of Patent: Mar. 25, 2003

(54) BIALLELIC MARKERS FOR USE IN CONSTRUCTING A HIGH DENSITY DISEQUILIBRIUM MAP OF THE HUMAN GENOME

(75) Inventors: Daniel Cohen, Neuilly-sur-Seine (FR); Ilya Chumakov, Vaux-le-Pénil (FR); Marta Blumenfeld, Paris (FR)

(73) Assignee: Genset S.A. (FR)

( * ) Notice: Subject to any disclaimer, the term of this patent is extended or adjusted under 35 U.S.C. 154(b) by 553 days.

(21) Appl. No.: 09/422,978

(22) Filed: Oct. 20, 1999

Related U.S. Application Data

(63) Continuation-in-part of application No. 09/298,850, filed on Apr. 21, 1999, now abandoned, and a continuation-in-part of application No. PCT/IB99/00822, filed on Apr. 21, 1999.
(60) Provisional application No. 60/109,732, filed on Nov. 23, 1998, and provisional application No. 60/082,614, filed on Apr. 21, 1998.

(51) Int. Cl.$^7$ ............................ C07H 21/04; C12Q 1/68

(52) U.S. Cl. ........................ 435/6; 435/91.2; 536/23.1; 536/24.3; 536/23.4

(58) Field of Search ................... 435/6, 91.2; 536/23.1, 536/24.3, 23.4

(56) References Cited

U.S. PATENT DOCUMENTS 5,589,136 A 12/1996 Northrup et al.

FOREIGN PATENT DOCUMENTS

| EP | 0 785 280 A2 | 7/1997 |
|---|---|---|
| WO | WO 91 13075 A | 9/1991 |
| WO | WO 95/12607 | 5/1996 |
| WO | WO 98/20165 | 5/1998 |
| WO | WO 99/04038 | 1/1999 |
| WO | WO 99/32644 | 7/1999 |

OTHER PUBLICATIONS

Gyapay, G., et al., "The 1993–94 Généthon Human Genetic Linkage Map", Nature Genetics, vol. 7, pp. 246–249, Jun. 1994.
Hillier et al. Genbank Accession No. AA143179, May 1997.*
Freitas et al. Genbank Accession No. AF050154, "Homo sapiens clonse F19374 Apo E–C2 gene cluster" Mar. 1999.*
Freitas et al. "Sequencing of 42kb of the APO E–C2 gene cluster reveals a new gene : PEREC1". DNA Sequence. vol. 9, No. 2, pp. 89–100, 1998.*
Benham, F., et al., "A Method for Generating Hybrids Containing Nonselected Fragments of Human Chromosomes". Gennomics, vol. 4 pp. 509–517.
Ches, M., et al., "Accessing Genetic Information with High–Density DNA Arrays", Science, vol. 274. pp. 610–614, Oct. 25, 1996.

Cherif, D., et al., "Simultaneous Localization of Cosmids and Chromosome R–banding by Fluorescence Microscopy: Application to Regional Mapping of Human Chromosome 11". Proc. Natl. Acad. Sci., vol. 87, pp. 6639–6643, Sep. 1990.
Chumakov, I. M., et al., "A YAC Contig Map of the Human Genome". Nature, vol. 377, pp. 175–287, Sep. 28, 1995.
Cox. D. et al., "Radiation Hybrid Mapping: A somatic Cell Genetic Method for Constructing High–Resolution Maps of Mammalian Chromosomes". Scinece. vol. 250. pp. 245–250, Oct. 12, 1990.
Cox, et al., "Assessing Mapping Progress in the Human Genome Project". Science. vol. 265, pp. 2031–2032, 1994.
Excoffier. L.. et al., "Maximum–Likelihood Estimation of Molecular Haplotype Frequencies in a Diploid Population", Mol. Biol. Evol., 1(15):921–927, 1995.
Fan, J., et al., "Genetic Mapping: Finding and Analyzing Single–Nucleotide Polymorphisms with High–Density DNA Arrays", Am. J. Human Genetics, vol. 71. No. 4, 1997.
Foster, J., et al., "High–Resolution Whole Genome Radiation Hybrid Map of Human Chromosome 17q22–q25.3 Across the Genes for GM and TK", Genomics, vol. 33, pp. 185–192, 1996.
Frazier, K., et al., "A Radiation Hybrid Map of the Region on Human Chromosome 22 Containing the Neurolibromatosis Type 2 Locus", Genomics, vol. 14, pp. 574–584. 1992.
Hudson. T., et al., "An STS–Based Map of the Human Genome", Science. vol. 270, pp. 1945–1954, Dec. 22, 1995.
Kim. et al., "Construction and Characterization of a Human Bacterial Artificial Chromosome Library", Genomics, vol. 34, pp. 213–218, 1996.
Kruglyak, L., "The Use of a Genetic Map of Biallelic Markers in Linkage Studies", Nature Genetics, vol. 17, Sep. 17, 1997.
Ledbetler, S., et al., Rapid Isolation of DNA Probes within Specific Chromosome Regions by Interspersed Repetitive Sequence Polymerase Chain Reaction. Genomics. vol. 5, pp. 475–481, 1990.

(List continued on next page.)

*Primary Examiner*—W. Gary Jones
*Assistant Examiner*—Jeanine Goldberg
(74) *Attorney, Agent, or Firm*—Saliwanchik, Lloyd & Saliwanchik

(57) ABSTRACT

The present invention relates to genomic maps comprising biallelic markers, new biallelic markers, and methods of using biallelic markers. Primers hybridizing to regions flanking these biallelic markers are also provided. This invention provides polynucleotides and methods suitable for genotyping a nucleic acid containing sample for one or more biallelic markers of the invention. Further, the invention provides a number of methods utilizing the biallelic markers of the invention including methods to detect a statistical correlation between a biallelic marker allele and a phenotype and/or between a biallelic marker haplotype and a phenotype.

5 Claims, 18 Drawing Sheets

OTHER PUBLICATIONS

Noether. Goulned E., "Introduction to Statistics. The Nonparametric Way", Springer–Verlag.

Obermayr. F., "A High–Resolution Radiation Hybrid Map of the Region Surrounding the Gorlin Syndrome Gene". Eur. J. Hum. Gene vol. 4. pp. 242–245, 1996.

Raeymaekers, P., et al., "A Radiation Hybrid Map with 60 Loci Covering the Entire Short Arm of Chromosome 12", Gennomics, vol. pp. 170–178, 1995.

Sapolsky, R., et al., "High–Throughput Polymorphism Screening and Genotyping with High–Density Oligonucleotide Arrays", Genetic Analysis, vol. 14, pp 187–192, 1999.

Schork, N., et al., "Linkage Disequilibrium Mapping Quantitative Traits within Case/Control Settings", Am. J. Human Genetics. vol. 61, No. 4, Suppl. p. A293, 1997.

Schuler, G.D., et al., A Gene Map of the Human Genome, Science, vol. 274, pp. 540–546, Oct. 25, 1996.

Syvanen, A., et al., "Identification of Individuals by Analysis Biallelic DNA Markers, Using PCR and Solid–Phase Minisequencing", J. Hum. Genet. 52:46–59, 1993.

Wang, D., et al., "Toward a Third Generation Genetic Map of the Human Genome Based on Bi–Allelic Polymorphisms", Am. J. Human Genet., vol. 59, p. A3. 1996.

Wang, D., et al., "Large–Scale Identification, Mapping and Genotyping of Single–Nucleotide Polymorphisms in the Human Genome", Science, vol. 280, pp. 1077–1082, May 15, 1998.

Warrington, J.A., et al., "Radiation Hybrid Map of 13 Loci on the Long Arm of Chromosome 5", Genomics, vol. 11, pp. 701–708, 1999.

Xiong, Li Jin. Bialletic Markers in Genelics Studies of Human Diseases: Their Power, Accuracy, and Density in Population–based Linkage Analyses.

Chumakov I., et al., "Continuum of Overlapping Clones Spanning the Entire Human Chromosome 21q", Nature, vol. 359, pp. 380–.

Cohen. D., et al., "A Fast–Generation Physical Map of the Human Genome", Nature, vol. 366, pp. 698–701, Mar. 14, 1996.

Dib C., et al., "A Comprehensive Genetic Map of the Human Genome Based on 5,264 Microsatellites", Nature, vol. 380, pp. 152–154, Mar. 14, 1996.

Doggett, N.A., et al., "An Integrated Physical Map of Human Chromosome 16", Nature, vol. 377, pp. 335–365, Sep. 28, 1995.

EMBL Database Accession No. HS448E20, Nov. 23, 1999.

Hacia, J.G., et al., "Detection of Heterozygous Mutations in BRCA1 Using High Density Oligonucleotide Arrays and Two–Colour Fluores cence Analysis", Nature, vol. 14, pp. 441–447, Dec. 14, 1996.

Hawley, M.E., et al., HAPLO: A Program Using the EM Algorithm to Estimate the Frequencies of Multi–Site Haplotypes. J. Or Heredity, 86(5): 409–411 (1995).

Kozai, M.J., et al., "Extensive Polymorphisms Observed in HIV–1 Clade B Protease Gene Using High–Density Oligonucleotide Array", Nature, vol. 2, pp. 753–759, Jul. 1996.

Larin, Z., "Fluorescence in Situ Hybridisatin of Multiple Probes on a Single Microscope Slide", Nucleic Acids Research vol. 22, No. 16, pp. 3589–3692, 1994.

Risch, N., et al., "The Futrue of Genetic Studies of Complex Human Diseases", Science, vol. 273, pp. 1516–1517, Sep. 13, 1996.

Shoemaker, D.D., et al., "Quantitative Phenotypic Analysis of Yeast Deletion Mutants Using a Highly Parallel Molecular Bar–Coding Strategy", Nature vol. 14, pp. 450–456, Dec. 14, 1996.

Wang D., et al., "Abstracts of papers presented at the 1997 meeting on Genome Mapping & Sequencing", Cold Spring Harbor Laboratory, p. 17, May 14–18, 1997.

Woo. Sung–Sick, et al., "Construction and Characterization of a Bacterial Artificial Chromosome Library of Sorghum Bicolor", Nucleic Acids Research. vol. 22, No. 22, pp. 4922–4931, 1994.

* cited by examiner

FIG. 3

| # aff | 150 | | | | | |
|---|---|---|---|---|---|---|
| # non aff | 150 | | | | | |
| pAi non aff | | 0 | 0,1 | 0,2 | 0,3 | 0,4 | 0,5 |
| Δ pAi | 0,05 | 8,7699E-05 | 0,06407752 | 0,14252002 | 0,19106311 | 0,21543442 | 0,22009395 |
| Δ pAi | 0,1 | 1,9149E-08 | 0,00060364 | 0,00467774 | 0,01023571 | 0,01382303 | 0,01382303 |
| Δ pAi | 0,15 | 3,0618E-12 | 1,3319E-06 | 3,8827E-05 | 0,0001478 | 0,0002343 | 0,00020218 |
| Δ pAi | 0,2 | 3,2153E-16 | 9,1413E-10 | 9,0305E-08 | 5,733E-07 | 9,6336E-07 | 5,733E-07 |
| Δ pAi | 0,25 | 2,0791E-20 | 2,2614E-13 | 6,2679E-11 | 5,873E-10 | 8,7113E-10 | 2,5396E-10 |
| Δ pAi | 0,3 | 7,8245E-25 | 2,152E-17 | 1,3261E-14 | 1,5189E-13 | 1,5189E-13 | 1,3261E-14 |
| Δ pAi | 0,35 | 1,6192E-29 | 7,9823E-22 | 8,4152E-19 | 9,1669E-18 | 4,2713E-18 | 5,5844E-20 |
| Δ pAi | 0,4 | 1,7336E-34 | 1,1282E-26 | 1,524E-23 | 1,1488E-22 | 1,524E-23 | 1,1282E-26 |

| # aff | 200 | | | | | |
|---|---|---|---|---|---|---|
| # non aff | 200 | | | | | |
| pAi non aff | | 0 | 0,1 | 0,2 | 0,3 | 0,4 | 0,5 |
| Δ pAi | 0,05 | 5,9233E-06 | 0,03250945 | 0,09039173 | 0,13111935 | 0,15260313 | 0,15678006 |
| Δ pAi | 0,1 | 8,649E-11 | 7,4765E-05 | 0,00109084 | 0,00302686 | 0,00447365 | 0,00447365 |
| Δ pAi | 0,15 | 8,0215E-16 | 2,3653E-08 | 2,0257E-06 | 1,1771E-05 | 2,1573E-05 | 1,7772E-05 |
| Δ pAi | 0,2 | 4,1762E-21 | 1,5375E-12 | 6,7374E-10 | 7,764E-09 | 1,5417E-08 | 7,764E-09 |
| Δ pAi | 0,25 | 1,1282E-26 | 2,525E-17 | 4,4025E-14 | 8,5532E-13 | 1,4423E-12 | 2,8149E-13 |
| Δ pAi | 0,3 | 1,4722E-32 | 1,1488E-22 | 5,8424E-19 | 1,4886E-17 | 1,4886E-17 | 5,842E-19 |
| Δ pAi | 0,35 | 8,6169E-39 | 1,4784E-28 | 1,5457E-24 | 3,6958E-23 | 1,3394E-23 | 4,197E-26 |
| Δ pAi | 0,4 | 2,0885E-45 | 5,2308E-35 | 7,6438E-31 | 1,1224E-29 | 7,6438E-31 | 5,2308E-35 |

| # aff | 500 | | | | | |
|---|---|---|---|---|---|---|
| # non aff | 500 | | | | | |
| pAi non aff | | 0 | 0,1 | 0,2 | 0,3 | 0,4 | 0,5 |
| Δ pAi | 0,05 | 8,0004E-13 | 0,00072323 | 0,00741965 | 0,0169842 | 0,02371865 | 0,02516449 |
| Δ pAi | 0,1 | 1,0695E-24 | 3,7948E-10 | 2,4176E-07 | 2,7579E-06 | 6,9679E-06 | 6,9679E-06 |
| Δ pAi | 0,15 | 3,813E-37 | 1,0719E-18 | 5,8344E-14 | 4,2622E-12 | 1,8601E-11 | 1,1611E-11 |
| Δ pAi | 0,2 | 2,9626E-50 | 5,0895E-29 | 1,6881E-22 | 6,9321E-20 | 3,7441E-19 | 6,9321E-20 |
| Δ pAi | 0,25 | 4,2697E-64 | 7,2043E-41 | 7,7528E-33 | 1,194E-29 | 4,3462E-29 | 7,6438E-31 |
| Δ pAi | 0,3 | 9,6976E-79 | 3,9328E-54 | 6,3017E-45 | 1,9429E-41 | 1,9429E-41 | 6,3017E-45 |
| Δ pAi | 0,35 | 2,911E-94 | 8,8513E-69 | 8,7879E-59 | 2,3478E-55 | 1,8839E-56 | 1,1206E-62 |
| Δ pAi | 0,4 | 9505E-111 | 7,7199E-85 | 1,8063E-74 | 1,4484E-71 | 1,8063E-74 | 7,7199E-85 |

| # aff | 150 | | | | | |
|---|---|---|---|---|---|---|
| # non aff | 850 | | | | | |
| pAi non aff | | 0 | 0,1 | 0,2 | 0,3 | 0,4 | 0,5 |
| Δ pAi | 0,05 | 2,1561E-20 | 0,00994614 | 0,04896055 | 0,08358651 | 0,10417953 | 0,11025423 |
| Δ pAi | 0,1 | 2,0126E-39 | 5,571E-07 | 0,00010149 | 0,00058665 | 0,00119145 | 0,00139743 |
| Δ pAi | 0,15 | 1,1091E-58 | 2,7555E-13 | 8,462E-09 | 2,9851E-07 | 1,2395E-06 | 1,6229E-06 |
| Δ pAi | 0,2 | 3,2726E-78 | 2,1683E-21 | 3,2211E-14 | 1,1049E-11 | 1,111E-10 | 1,5638E-10 |
| Δ pAi | 0,25 | 4,9576E-98 | 4,4952E-31 | 6,5226E-21 | 3,1015E-17 | 2,5169E-16 | 1,1763E-15 |
| Δ pAi | 0,3 | 3,749E-118 | 3,6987E-42 | 8,129E-29 | 6,9335E-24 | 5,4331E-22 | 6,5657E-22 |
| Δ pAi | 0,35 | 1,383E-138 | 1,6797E-54 | 7,1058E-38 | 1,2938E-31 | 2,9415E-29 | 2,5869E-29 |
| Δ pAi | 0,4 | 2,435E-159 | 5,4915E-68 | 4,8846E-48 | 2,1003E-40 | 1,3332E-37 | 6,8178E-38 |

| # aff | 200 | | | | | |
|---|---|---|---|---|---|---|
| # non aff | 500 | | | | | |
| pAi non aff | | 0 | 0,1 | 0,2 | 0,3 | 0,4 | 0,5 |
| Δ pAi | 0,05 | 1,0628E-12 | 0,00789803 | 0,03942584 | 0,06867566 | 0,08621572 | 0,09083704 |
| Δ pAi | 0,1 | 3,4525E-24 | 4,4217E-07 | 5,6883E-05 | 0,00031976 | 0,0006363 | 0,00070881 |
| Δ pAi | 0,15 | 5,9036E-36 | 4,3025E-13 | 3,3635E-09 | 9,2134E-08 | 3,319E-07 | 3,5871E-07 |
| Δ pAi | 0,2 | 4,7325E-48 | 1,5566E-20 | 1,0346E-14 | 1,7218E-12 | 1,1512E-11 | 1,0047E-11 |
| Δ pAi | 0,25 | 1,6694E-60 | 3,5436E-29 | 2,0473E-21 | 2,2178E-18 | 1,1498E-17 | 1,3524E-17 |
| Δ pAi | 0,3 | 2,4613E-73 | 7,2498E-39 | 3,0748E-29 | 2,0601E-25 | 3,4525E-24 | 7,4807E-25 |
| Δ pAi | 0,35 | 1,4447E-86 | 1,6945E-49 | 3,9559E-38 | 1,4118E-33 | 2,662E-32 | 1,4118E-33 |
| Δ pAi | 0,4 | 3,214E-100 | 5,3051E-61 | 4,7325E-48 | 7,1282E-43 | 1,0691E-41 | 7,2652E-44 |

| # aff | 500 | | | | | |
|---|---|---|---|---|---|---|
| # non aff | 1000 | | | | | |
| pAi non aff | | 0 | 0,1 | 0,2 | 0,3 | 0,4 | 0,5 |
| Δ pAi | 0,05 | 6,4766E-24 | 5,7827E-05 | 0,00172627 | 0,00551541 | 0,00882876 | 0,00978249 |
| Δ pAi | 0,1 | 6,5309E-47 | 3,065E-14 | 1,0301E-09 | 4,3205E-08 | 1,8833E-07 | 2,2731E-07 |
| Δ pAi | 0,15 | 1,1969E-70 | 2,0716E-27 | 3,7441E-19 | 4,6626E-16 | 6,9719E-15 | 6,9719E-15 |
| Δ pAi | 0,2 | 3,3252E-95 | 1,1636E-43 | 1,6614E-31 | 8,5632E-27 | 4,1421E-25 | 1,9885E-25 |
| Δ pAi | 0,25 | 1,227E-120 | 1,7683E-62 | 1,5329E-46 | 3,1722E-40 | 8,6765E-39 | 3,6071E-39 |
| Δ pAi | 0,3 | 5,303E-147 | 1,526E-83 | 4,2697E-64 | 2,5968E-56 | 3,9328E-54 | 2,5968E-56 |
| Δ pAi | 0,35 | 2,36E-174 | 1,184E-106 | 4,5658E-84 | 4,7426E-75 | 4,2624E-73 | 4,0958E-77 |
| Δ pAi | 0,4 | 9,446E-203 | 1,082E-131 | 2,137E-106 | 1,8014E-96 | 3,3252E-95 | 6,725E-102 |

| markers | 99-366 | 99-344 | 99-359 | 99-355 | haplotype frequencies | | odds-ratio | P value |
| --- | --- | --- | --- | --- | --- | --- | --- | --- |
| p value | 3.01E-01 | 1.11E-01 | 6.63E-01 | 1.38E-01 | cases | controls | | |
| haplotype 1 | C | G | | | 0.404 | 0.308 | 1.52 | 3.05E-03 *** |
| haplotype 2 | | G | A | | 0.203 | 0.165 | 1.29 | 1.24E-01 * |
| haplotype 3 | | | G | G | 0.375 | 0.306 | 1.36 | 2.83E-02 ** |
| haplotype 4 | C | G | A | | 0.264 | 0.209 | 1.36 | 5.95E-02 ** |
| haplotype 5 | | | | A | 0.115 | 0.071 | 1.70 | 1.64E-02 ** |
| haplotype 6 | C | | | A | 0.15 | 0.129 | 1.19 | 3.59E-01 * |
| haplotype 7 | T | | G | G | 0.225 | 0.122 | 2.09 | 4.76E-05 ***** |
| haplotype 8 | T | A | G | G | 0.228 | 0.108 | 2.44 | 2.05E-06 ****** |

POPULATIONS: AD CASES (225) | AD CONTROLS (248)

Figure 7

| | PROSTATE CANCER | NON-AFFECTED |
|---|---|---|
| | CASES (281) | CONTROLS (130) |
| characteristics of populations | 143 sporadic cases + 138 familial cases | > 65 years PSA<4 |

| markers | 99-123 | 4-26 | 4-14 | 4-77 | 99-217 | 4-67 | 99-213 | 99-221 | 99-135 | haplotype frequencies | | relative risk | pvalue | |
|---|---|---|---|---|---|---|---|---|---|---|---|---|---|---|
| bacs | H0287B09 | B0189E08 | | | | B0463F01 | | | B0725B12 | | | | | |
| genes | | | | <----------PG1----------> | | | | | | | | | | |
| p value | 2.00E-01 | 1.00E-01 | 1.00E-01 | 2.00E-02 | 2.00E-02 | 6.00E-04 | 9.00E-02 | 7.00E-01 | 2.00E-01 | cases | controls | | | |
| haplotype 8 >304kb< | C | A | C | G | T | T | C | A | A | 0.075 | 0.018 | 4.42 | 9.00E-04 | *** |
| haplotype 7 >286kb< | | A | C | G | T | T | C | A | A | 0.095 | 0.016 | 6.46 | 6.00E-05 | **** |
| haplotype 6 <186kb> | | A | C | G | T | T | C | A | | 0.116 | 0.019 | 6.78 | 1.00E-05 | ***** |
| haplotype 5 <171kb> | | | C | G | T | T | C | A | | 0.117 | 0.013 | 10.06 | 9.00E-07 | ****** |
| haplotype 4 <83kb> | | | | G | T | T | C | A | | 0.117 | 0.025 | 5.17 | 2.00E-05 | ***** |
| haplotype 3.1 <54kb> | | | | | T | T | C | A | | 0.117 | 0.027 | 4.78 | 2.00E-05 | ***** |
| haplotype 3.2 <54kb> | | | | G | T | T | C | | | 0.222 | 0.109 | 2.33 | 4.00E-05 | ***** |
| haplotype 2.2 <39kb> | | | | G | T | T | C | | | 0.251 | 0.134 | 2.17 | 2.00E-04 | **** |
| haplotype 2 <32kb> | | | | | T | T | C | | | 0.226 | 0.112 | 2.32 | 1.00E-04 | *** |
| haplotype 1.1 <17 kb> | | | | | | T | | | | 0.256 | 0.146 | 2.01 | 3.00E-04 | **** |
| haplotype 1.2 <15 kb> | | | | | | T | C | | | 0.233 | 0.129 | 2.05 | 6.00E-04 | *** |

Figure 12

PROSTATE CANCER HAPLOTYPE SIMULATIONS (100 ITERATIONS)
| markers | 4-14 | 4-77 | 99-217 | 4-67 | 99-213 | 99-221 | haplotype frequencies | | relative risk | pvalue |
| --- | --- | --- | --- | --- | --- | --- | --- | --- | --- | --- |
| | | | | | | | cases | controls | | |
| haplotype | C | G | T | T | G | A | 0.117 | 0.013 | 10.06 | 9.00E-07 |
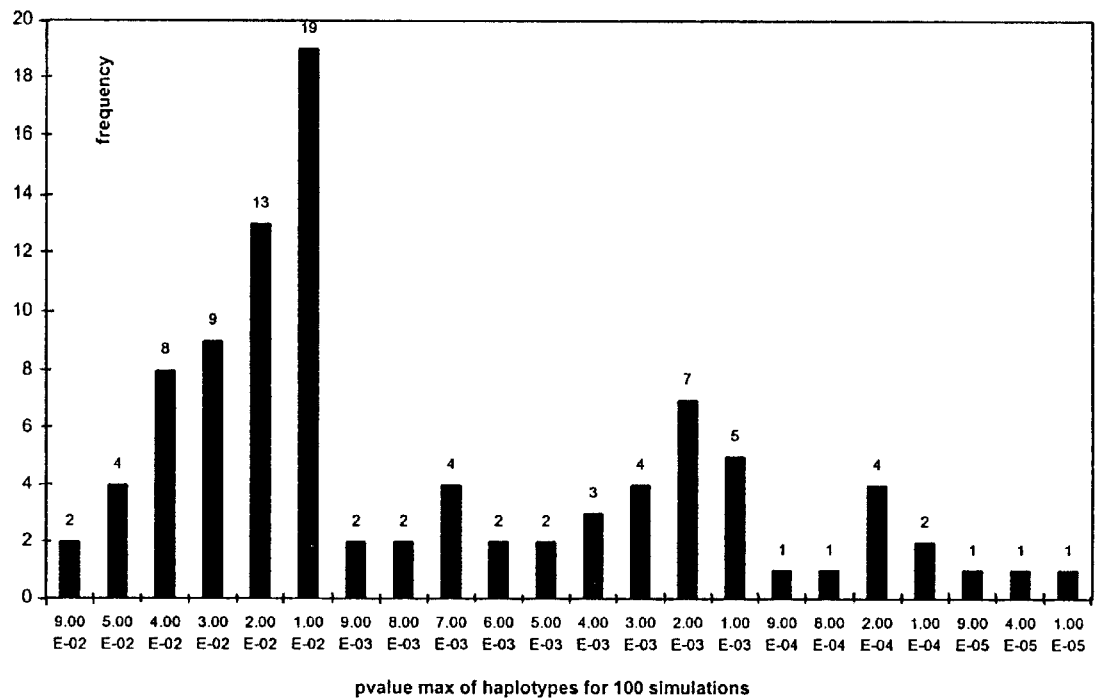
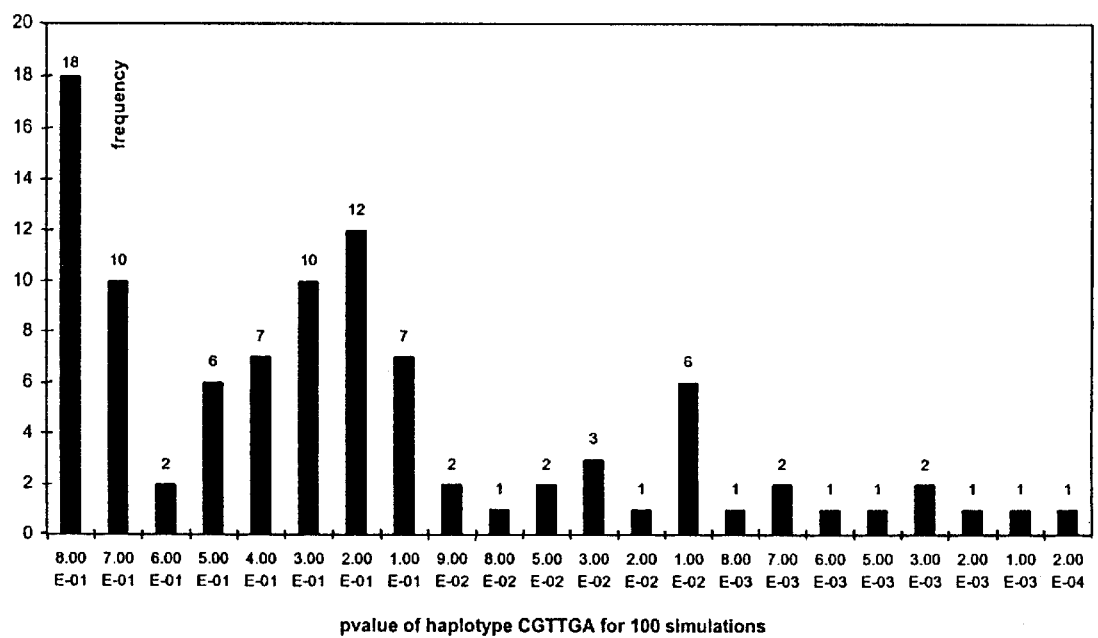
Figure 13

BIALLELIC MARKERS FOR USE IN CONSTRUCTING A HIGH DENSITY DISEQUILIBRIUM MAP OF THE HUMAN GENOME

RELATED APPLICATIONS

The present application is a Continuation-in-Part application of U.S. patent application Ser. No. 09/298,850, filed Apr. 21, 1999, now abandoned, and International Patent Application No. PCT/IB99/00822, filed Apr. 21, 1999, which both claim priority to U.S. Provisional Patent Application Serial No. 60/082,614, filed Apr. 21, 1998 and U.S. Provisional Patent Application Serial No. 60/109,732, filed Nov. 23, 1998, the disclosures of each of which are incorporated herein by reference in their entireties.

BACKGROUND OF THE INVENTION

Recent advances in genetic engineering and bioinformatics have enabled the manipulation and characterization of large portions of the human genome. While efforts to obtain the full sequence of the human genome are rapidly progressing, there are many practical uses for genetic information which can be implemented with partial knowledge of the sequence of the human genome.

As the full sequence of the human genome is assembled, the partial sequence information available can be used to identify genes responsible for detectable human traits, such as genes associated with human diseases, and to develop diagnostic tests capable of identifying individuals who express a detectable trait as the result of a specific genotype or individuals whose genotype places them at risk of developing a detectable trait at a subsequent time. Each of these applications for partial genomic sequence information is based upon the assembly of genetic and physical maps which order the known genomic sequences along the human chromosomes.

The present invention relates to an ordered set of human genomic sequences comprising single nucleotide polymorphisms, as well as the use of these polymorphisms as a high resolution map of the human genome, methods of identifying genes associated with detectable human traits, and diagnostics for identifying individuals who carry a gene which causes them to express a detectable trait or which places them at risk of expressing a detectable trait in the future.

Advantages of the Biallelic Markers of the Present Invention

The map-related biallelic markers of the present invention offer a number of important advantages over other genetic markers such as RFLP (Restriction fragment length polymorphism), VNTR (Variable Number of Tandem Repeats) markers and earlier STS-(sequence tagged sites) derived markers.

The first generation of markers, RFLPs, are variations that modify the length of a restriction fragment. However, methods used to identify and type RFLPs are relatively wasteful of materials, effort, and time. Since they are biallelic markers (they present only two alleles, the restriction site being either present or absent), their maximum heterozygosity is 0.5. The theoretical number of RFLPs distributed along the entire human genome is more than $10^5$, which leads to a potential average inter-marker distance of 30 kilobases. However, in reality, the number of evenly distributed RFLPs which occurs at a sufficient frequency in the population to make them useful for tracking of genetic polymorphisms is very limited.

The second generation of genetic markers were VNTRs, which can be categorized as either minisatellites or microsatellites. Minisatellites are tandemly repeated DNA sequences present in units of 5–50 repeats which are distributed along regions of the human chromosomes ranging from 0.1 to 20 kilobases in length. Since they present many possible alleles, their informative content is very high. Minisatellites are scored by performing Southern blots to identify the number of tandem repeats present in a nucleic acid sample from the individual being tested. However, there are only $10^4$ potential VNTRs that can be typed by Southern blotting. Thus, the number of easily typed informative markers in these maps is far too small for the average distance between informative markers to fulfill the requirements for a useful genetic map. Moreover, both RFLP and VNTR markers are costly and time-consuming to develop and assay in large numbers.

Initial attempts to construct genetic maps based on non-RFLP biallelic markers have focused on identifying biallelic markers lying within sequence tagged sites (STS), pieces of genomic DNA having a known sequence and averaging about 250 bases in length. More than 30,000 STSs have been identified and ordered along the genome (Hudson et al., *Science* 270:1945–1954 (1995); Schuler et al., *Science* 274:540–546 (1996), the disclosures of which are incorporated herein by reference in their entireties). For example, the Whitehead Institute and Genethon's integrated map contains 15,086 STSs.

These sequence tagged sites can be screened to identify polymorphisms, preferably Single Nucleotide Polymorphisms (SNPs), more preferably non RFLP biallelic markers therein. Generally polymorphisms are identified by determining the sequence of the STSs in 5 to 10 individuals.

Wang et al. (Cold Spring Harbor Laboratory: *Abstracts of Papers Presented on Genome Mapping and Sequencing* p. 17 (May 14–18, 1997), the disclosure of which is incorporated herein by reference in its entirety) recently announced the identification and mapping of 750 Single Nucleotide Polymorphisms issued from the sequencing of 12,000 STSs from the Whitehead/MIT map, in eight unrelated individuals. The map was assembled using a high throughput system based on the utilization of DNA chip technology available from Affymetrix (Chee et al., *Science* 274:610–614 (1996), the disclosure of which is incorporated herein by reference in its entirety).

However, according to experimental data and statistical calculations, less than one out of 10 of all STSs mapped today will contain an informative Single Nucleotide Polymorphism. This is primarily due to the short length of existing STSs (usually less than 250 bp). If one assumes $10^6$ informative SNPs spread along the human genome, there would on average be one marker of interest every $3\times10^9/10^6$, i.e. every 3,000 bp. The probability that one such marker is present on a 250 bp stretch is thus less than $\frac{1}{10}$.

While it could produce a high density map, the STS approach based on currently existing markers does not put any systematic effort into making sure that the markers obtained are optimally distributed throughout the entire genome. Instead, polymorphisms are limited to those locations for which STSs are available.

The even distribution of markers along the chromosomes is critical to the future success of genetic analyses. In particular, a high density map having appropriately spaced markers is essential for conducting association studies on sporadic cases, aiming at identifying genes responsible for detectable traits such as those which are described below.

As will be further explained below, genetic studies have mostly relied in the past on a statistical approach called linkage analysis, which took advantage of microsatellite markers to study their inheritance pattern within families from which a sufficient number of individuals presented the studied trait. Because of intrinsic limitations of linkage analysis, which will be further detailed below, and because these studies necessitate the recruitment of adequate family pedigrees, they are not well suited to the genetic analysis of all traits, particularly those for which only sporadic cases are available (e.g. drug response traits), or those which have a low penetrance within the studied population.

Association studies enabled by the biallelic markers of the present invention offer an alternative to linkage analysis. Combined with the use of a high density map of appropriately spaced, sufficiently informative markers, association studies, including linkage disequilibrium-based genome wide association studies, will enable the identification of most genes involved in complex traits.

Single nucleotide polymorphism or biallelic markers can be used in the same manner as RFLPs and VNTRs but offer several advantages. Single nucleotide polymorphisms are densely spaced in the human genome and represent the most frequent type of variation. An estimated number of more than $10^7$ sites are scattered along the $3 \times 10^9$ base pairs of the human genome. Therefore, single nucleotide polymorphisms occur at a greater frequency and with greater uniformity than RFLP or VNTR markers which means that there is a greater probability that such a marker will be found in close proximity to a genetic locus of interest. Single nucleotide polymorphisms are less variable than VNTR markers but are mutationally more stable.

Also, the different forms of a characterized single nucleotide polymorphism, such as the biallelic markers of the present invention, are often easier to distinguish and can therefore be typed easily on a routine basis. Biallelic markers have single nucleotide based alleles and they have only two common alleles, which allows highly parallel detection and automated scoring. The biallelic markers of the present invention offer the possibility of rapid, high-throughput genotyping of a large number of individuals.

Biallelic markers are densely spaced in the genome, sufficiently informative and can be assayed in large numbers. The combined effects of these advantages make biallelic markers extremely valuable in genetic studies. Biallelic markers can be used in linkage studies in families, in allele sharing methods, in linkage disequilibrium studies in populations, in association studies of case-control populations. An important aspect of the present invention is that biallelic markers allow association studies to be performed to identify genes involved in complex traits. Association studies examine the frequency of marker alleles in unrelated case- and control-populations and are generally employed in the detection of polygenic or sporadic traits. Association studies may be conducted within the general population and are not limited to studies performed on related individuals in affected families (linkage studies). Biallelic markers in different genes can be screened in parallel for direct association with disease or response to a treatment. This multiple gene approach is a powerful tool for a variety of human genetic studies as it provides the necessary statistical power to examine the synergistic effect of multiple genetic factors on a particular phenotype, drug response, sporadic trait, or disease state with a complex genetic etiology.

The present invention relates to a high density linkage disequilibrium-based genetic maps of the human genome which comprise the map-related biallelic markers of the invention and will allow the identification of genes responsible for detectable traits using genome-wide association studies and linkage disequilibrium mapping.

SUMMARY OF THE INVENTION

The present invention is based on the discovery of a set of novel map-related biallelic markers (See Table 1). The position of these markers and knowledge of the surrounding sequence have been used to design polynucleotide compositions which are useful in high density mapping of the human genome as well as in determining the identity of nucleotides at the marker position, and more complex association and haplotyping studies which are useful in determining the genetic basis for disease states. In addition, the compositions and methods of the invention find use in the identification of the targets for the development of pharmaceutical agents and diagnostic methods, as well as in the characterization of the differential efficacious responses to and side effects from pharmaceutical agents acting on a disease as well as other treatments.

A first embodiment of the present invention is a map of the human genome comprising an ordered array of biallelic markers, wherein at least 1, 2, 5, 10, 20, 25, 30, 50, 100, 200, 500, 1000, 2000 or 3000 of said biallelic markers are map-related biallelic markers. In addition, the maps of the present invention encompass maps with any further limitation described in this disclosure, or those following, specified alone or in any combination: optionally, said map-related biallelic marker may be selected individually or in any combination from the group consisting of the biallelic markers of SEQ ID Nos. 1 to 3908, 1 to 2260, 2261 to 3734, 3734 to 3908 and the complements thereof; optionally said ordered array comprises at least 20,000, 40,000, 60,000, 80,000, 100,000, or 120,000 biallelic markers; optionally, wherein said biallelic markers are separated from one another by an average distance of 10 kb–200 kb, 15 kb–150 kb, 20 kb–100 kb, 100 kb–150 kb, 50–100 kb, or 25 kb–50 kb in the human genome; optionally, said biallelic markers are distributed at an average density of at least one biallelic marker every 150 kb, 50 kb, or 30 kb in the human genome; or optionally, wherein, all of said biallelic markers are selected to have a heterozygosity rates of at least about 0.18, 0.32, or 0.42.

A second embodiment of the invention encompasses isolated, purified or recombinant polynucleotides consisting of, consisting essentially of, or comprising a contiguous span of nucleotides of a sequence selected as an individual or in any combination from the group consisting of SEQ ID No. 1 to 3908, 1 to 2260, 2261 to 3734, 3734 to 3908, 3935 to 7842, 7866 to 11773, 3935 to 6194, 6195 to 7668, 7669 to 7842, 7866 to 10125, 10126 to 11599, and 11600 to 11773, or the complements thereof, wherein said contiguous span is at least 8, 10, 12, 15, 18, 19, 20, 21, 22, 23, 24, 25, 30, 35, 43, 44, 45, 46 or 47 nucleotides in length, to the extent that a contiguous span of these lengths is consistent with the lengths of the particular Sequence ID. The present invention also relates to polynucleotides hybridizing under stringent or intermediate conditions to a sequence selected from the group consisting of SEQ ID No. 1 to 3908, 1 to 2260, 2261 to 3734, 3734 to 3908, 3935 to 7842, 7866 to 11773, 3935 to 6194, 6195 to 7668, 7669 to 7842, 7866 to 10125, 10126 to 11599, and 11600 to 11773 and the complements thereof. In addition, the polynucleotides of the invention encompass polynucleotides with any further limitation described in this disclosure, or those following, specified alone or in any combination: said contiguous span may optionally comprise a map-related biallelic marker; optionally either the 1st or the 2nd allele of the respective SEQ ID No., as indicated in Table 1, may be specified as being present at said map-related biallelic marker; optionally, said biallelic marker may be within 6, 5, 4, 3, 2, or 1 nucleotides of the center of said polynucleotide or at the center of said polynucleotide; optionally, said polynucleotide may comprise, consist of, or consist essentially of a contiguous span which ranges in length from 8, 10, 12, 15, 18 or 20 to 21, 25, 35, 40, 43, or 47 nucleotides; optionally, said polynucleotide may comprise, consist of, or consist essentially of a contiguous span which ranges in length from 8, 10, 12, 15, 18 or 20 to 21, 25, 35, 40, 43, or 47 nucleotides, or be specified as being 12, 15, 18, 20, 25, 35, 40, 43, or 47 nucleotides in length and including an map-related biallelic marker of said sequence, and optionally the 1st allele of Table 1 is present at said biallelic marker; optionally, the 3' end of said contiguous span may be present at the 3' end of said polynucleotide; optionally, biallelic marker may be present at the 3' end of said polynucleotide; optionally, the 3' end of said polynucleotide may be located within or at least 2, 4, 6, 8, or 10 nucleotides upstream of a map-related biallelic marker in said sequence, to the extent that such a distance is consistent with the lengths of the particular Sequence ID; optionally, the 3' end of said polynucleotide may be located 1 nucleotide upstream of a map-related biallelic marker in said sequence; and optionally, said polynucleotide may further comprise a label.

A third embodiment of the invention encompasses any polynucleotide of the invention attached to a solid support. In addition, the polynucleotides of the invention which are attached to a solid support encompass polynucleotides with any further limitation described in this disclosure, or those following, specified alone or in any combination: optionally, said polynucleotides may be specified as attached individually or in groups of at least 2, 5, 8, 10, 12, 15, 20, 25, 50, 100, 200, or 500 distinct polynucleotides of the inventions to a single solid support; optionally, polynucleotides other than those of the invention may attached to the same solid support as polynucleotides of the invention; optionally, when multiple polynucleotides are attached to a solid support they may be attached at random locations, or in an ordered array; optionally, said ordered array may be addressable.

A fourth embodiment of the invention encompasses the use of any polynucleotide for, or any polynucleotide for use in, determining the identity of nucleotides at a map-related biallelic marker. In addition, the polynucleotides of the invention for use in determining the identity of nucleotides at a map-related biallelic marker encompass polynucleotides with any further limitation described in this disclosure, or those following, specified alone or in any combination: optionally, said map-related biallelic marker may be selected individually or in any combination from the group consisting of the biallelic markers of SEQ ID No. 1 to 3908, 1 to 2260, 2261 to 3734, 3734 to 3908 and the complements thereof; optionally, said polynucleotide may comprise a sequence disclosed in the present specification; optionally, said polynucleotide may comprise, consist of, or consist essentially of any polynucleotide described in the present specification; optionally, said determining may be performed in a hybridization assay, sequencing assay, microsequencing assay, or an enzyme-based mismatch detection assay; optionally, said polynucleotide may be attached to a solid support, array, or addressable array; optionally, said polynucleotide may be labeled.

A fifth embodiment of the invention encompasses the use of any polynucleotide for, or any polynucleotide for use in, amplifying a segment of nucleotides comprising a map-related biallelic marker. In addition, the polynucleotides of the invention for use in amplifying a segment of nucleotides comprising a map-related biallelic marker encompass polynucleotides with any further limitation described in this disclosure, or those following, specified alone or in any combination: optionally, said map-related biallelic marker may be selected individually or in any combination from the group consisting of the biallelic markers of SEQ ID Nos. 1 to 3908, 1 to 2260, 2261 to 3734, 3734 to 3908 and the complements thereof; optionally, said polynucleotide may comprise, consist of, consist essentially of, or comprise a sequence selected individually or in any combination from the group consisting of SEQ ID Nos. 3935 to 7842, 7866 to 11773, 3935 to 6194, 6195 to 7668, 7669 to 7842, 7866 to 10125, 10126 to 11599, and 11600 to 11773; optionally, said polynucleotide may comprise, consist of, or consist essentially of any polynucleotide described in the present specification; optionally, said amplifying may be performed by a PCR or LCR. Optionally, said polynucleotide may be attached to a solid support, array, or addressable array. Optionally, said polynucleotide may be labeled.

A sixth embodiment of the invention encompasses methods of genotyping a biological sample comprising determining the identity of a nucleotide at a map-related biallelic marker. In addition, the genotyping methods of the invention encompass methods with any further limitation described in this disclosure, or those following, specified alone or in any combination: optionally, said map-related biallelic marker may be selected individually or in any combination from the group consisting of the biallelic markers of SEQ ID No. 1 to 3908, 1 to 2260, 2261 to 3734, 3734 to 3908 and the complements thereof; optionally, said method further comprises determining the identity of a second nucleotide at said biallelic marker, wherein said first nucleotide and second nucleotide are not base paired (by Watson & Crick base pairing) to one another; optionally, said biological sample is derived from a single individual or subject; optionally, said method is performed in vitro; optionally, said biallelic marker is determined for both copies of said biallelic marker present in said individual's genome; optionally, said biological sample is derived from multiple subjects or individuals; optionally, said method further comprises amplifying a portion of said sequence comprising the biallelic marker prior to said determining step; optionally, wherein said amplifying is performed by PCR, LCR, or replication of a recombinant vector comprising an origin of replication and said portion in a host cell; optionally, wherein said determining is performed by a hybridization assay, sequencing assay, microsequencing assay, or an enzyme-based mismatch detection assay.

A seventh embodiment of the invention comprises methods of estimating the frequency of an allele in a population comprising genotyping individuals from said population for a map-related biallelic marker and determining the proportional representation of said biallelic marker in said population. In addition, the methods of estimating the frequency of an allele in a population of the invention encompass methods with any further limitation described in this disclosure, or those following, specified alone or in any combination: optionally, said map-related biallelic marker may be selected individually or in any combination from the group consisting of the biallelic markers of SEQ ID Nos. 1 to 3908, 1 to 2260, 2261 to 3734, 3734 to 3908 and the complements thereof; optionally, determining the frequency of a biallelic marker allele in a population may be accomplished by determining the identity of the nucleotides for both copies of said biallelic marker present in the genome of each individual in said population and calculating the proportional representation of said nucleotide at said map-related biallelic marker for the population; optionally, determining the frequency of a biallelic marker allele in a population may be accomplished by performing a genotyping method on a pooled biological sample derived from a representative number of individuals, or each individual, in said population, and calculating the proportional amount of said nucleotide compared with the total.

An eighth embodiment of the invention comprises methods of detecting an association between an allele and a phenotype, comprising the steps of a) determining the frequency of at least one map-related biallelic marker allele in a trait positive population, b) determining the frequency of said map-related biallelic marker allele in a control population and; c) determining whether a statistically significant association exists between said genotype and said phenotype. In addition, the methods of detecting an association between an allele and a phenotype of the invention encompass methods with any further limitation described in this disclosure, or those following, specified alone or in any combination: optionally, said map-related biallelic marker may be selected individually or in any combination from the group consisting of the biallelic markers of SEQ ID Nos. 1 to 3908, 1 to 2260, 2261 to 3734, 3734 to 3908 and the complements thereof, optionally, said control population may be a trait-negative population, or a random population; optionally, wherein said phenotype is selected from the group consisting of disease, treatment response, treatment efficacy, drug response, drug efficacy, and drug toxicity; optionally, the determining steps a) and b) are performed on all of the biallelic markers of SEQ ID Nos. 1 to 3908.

An ninth embodiment of the present invention encompasses methods of estimating the frequency of a haplotype for a set of biallelic markers in a population, comprising the steps of: a) genotyping each individual in said population for at least one map-related biallelic marker, b) genotyping each individual in said population for a second biallelic marker by determining the identity of the nucleotides at said second biallelic marker for both copies of said second biallelic marker present in the genome; and c) applying a haplotype determination method to the identities of the nucleotides determined in steps a) and b) to obtain an estimate of said frequency. In addition, the methods of estimating the frequency of a haplotype of the invention encompass methods with any further limitation described in this disclosure, or those following, specified alone or in any combination: optionally said haplotype determination method is selected from the group consisting of asymmetric PCR amplification, double PCR amplification of specific alleles, the Clark method, or an expectation maximization algorithm; optionally, said map-related biallelic marker may be selected individually or in any combination from the group consisting of the biallelic markers of SEQ ID Nos. 1 to 3908, 1 to 2260, 2261 to 3734, 3734 to 3908 and the complements thereof; optionally, said second biallelic marker is a map-related biallelic marker; optionally, the identity of the nucleotides at the biallelic markers in every one of the sequences of SEQ ID No. 1 to 3908 is determined in steps a) and b).

A tenth embodiment of the present invention encompasses methods of detecting an association between a haplotype and a phenotype, comprising the steps of: a) estimating the frequency of at least one haplotype in a trait positive population according to a method of estimating the frequency of a haplotype of the invention; b) estimating the frequency of said haplotype in a control population according to the method of estimating the frequency of a haplotype of the invention; and c) determining whether a statistically significant association exists between said haplotype and said phenotype. In addition, the methods of detecting an association between a haplotype and a phenotype of the invention encompass methods with any further limitation described in this disclosure, or those following, specified alone or in any combination: optionally, said map-related biallelic marker may be in a sequence selected individually or in any combination from the group consisting of SEQ ID No. 1 to 3908, 1 to 2260, 2261 to 3734, 3734 to 3908 and the complements thereof; optionally, said control population may be a trait-negative population, or a random population; optionally, wherein said phenotype is selected from the group consisting of disease, treatment response, treatment efficacy, drug response, drug efficacy, and drug toxicity; optionally, the identity of the nucleotides at the biallelic markers in every one of the following sequences: SEQ ID No. 1 to 3908 is included in the estimating steps a) and b).

An eleventh embodiment of the present invention is a method of identifying a gene associated with a detectable trait comprising the steps of: a) determining the frequency of each allele of at least one map-related biallelic marker in individuals having the detectable trait and individuals lacking the detectable trait; b) identifying at least one alleles of one or biallelic markers having a statistically significant association with the detectable trait; and c) identifying a gene in linkage disequilibrium with said allele. In addition, the methods of the present invention for identifying a gene associated with a detectable trait encompass methods with any further limitation described in this disclosure, or those following, specified alone or in any combination: optionally, wherein the method further comprises d) identifying a mutation in the gene identified in step c) which is associated with the detectable trait; optionally, wherein the individuals having the detectable trait and the individuals lacking the detectable trait are readily distinguishable from one another; optionally, wherein the individuals having the detectable trait and the individuals lacking the detectable trait are selected from a bimodal population; optionally, wherein the individuals having the detectable trait are at one extreme of the population and the individuals lacking the detectable trait are at the other extreme of the population; optionally, said map-related biallelic marker may be in a sequence selected individually or in any combination from the group consisting of SEQ ID No. 1 to 3908, 1 to 2260, 2261 to 3734, 3734 to 3908 and the complements thereof; optionally, wherein said detectable trait is selected from the group consisting of disease, treatment response, treatment efficacy, drug response, drug efficacy, and drug toxicity.

A twelfth embodiment of the present invention is a method of identifying biallelic markers associated with a detectable trait comprising the steps of: a) determining the frequencies of a set of biallelic markers comprising at least one map-related biallelic marker in individuals who express said detectable trait and individuals who do not express said detectable trait; and b) identifying one or more biallelic markers in said set which are statistically associated with the expression of said detectable trait. In addition, the methods of the present invention for identifying biallelic markers associated with a detectable trait encompass methods with any further limitation described in this disclosure, or those following, specified alone or in any combination: optionally, said map-related biallelic marker may be in a sequence selected individually or in any combination from the group consisting of SEQ ID No. 1 to 3908, 1 to 2260, 2261 to 3734, 3734 to 3908 and the complements thereof; optionally, wherein said detectable trait is selected from the group consisting of disease, treatment response, treatment efficacy, drug response, drug efficacy, and drug toxicity.

A thirteenth embodiment of the present invention is a method of identifying biallelic marker(s) in linkage disequilibrium with a trait causing allele or in linkage disequilibrium with a trait-associated biallelic marker comprising the steps of: a) selecting at least one map-related biallelic marker which is in the genomic region suspected of containing the trait-causing allele or the trait-associated biallelic marker; and b) determining which of the map-related biallelic markers are associated with the trait-causing allele or in linkage disequilibrium with the trait-associated biallelic marker. In addition, the methods of the present invention for identifying biallelic marker(s) in linkage disequilibrium with a trait causing allele or in linkage disequilibrium with a trait-associated biallelic marker encompass methods with any further limitation described in this disclosure, or those following, specified alone or in any combination: optionally, said map-related biallelic marker may be in a sequence selected individually or in any combination from the group consisting of SEQ ID No. 1 to 3908, 1 to 2260, 2261 to 3734, 3734 to 3908 and the complements thereof; optionally, wherein said detectable trait is selected from the group consisting of disease, treatment response, treatment efficacy, drug response, drug efficacy, and drug toxicity.

A fourteenth embodiment of the present invention is a method for determining whether an individual is at risk of developing a detectable trait or suffers from a detectable trait comprising the steps of: a) obtaining a nucleic acid sample from the individual; b) screening the nucleic acid sample with at least one map-related biallelic marker; and c) determining whether the nucleic acid sample contains at least one allele of said map-related biallelic marker statistically associated with the detectable trait. In addition, the methods of the present invention for determining whether an individual is at risk of developing a detectable trait or suffers from a detectable trait encompass methods with any further limitation described in this disclosure, or those following, specified alone or in any combination: optionally, said map-related biallelic marker may be in a sequence selected individually or in any combination from the group consisting of SEQ ID No. 1 to 3908, 1 to 2260, 2261 to 3734, 3734 to 3908 and the complements thereof; optionally, wherein said detectable trait is selected from the group consisting of disease, treatment response, treatment efficacy, drug response, drug efficacy, and drug toxicity.

A fifteenth embodiment of the present invention is a method of administering a drug or a treatment comprising the steps of: a) obtaining a nucleic acid sample from an individual; b) determining the identity of the polymorphic base of at least one map-related biallelic marker which is associated with a positive response to the treatment or the drug; or at least one biallelic map-related marker which is associated with a negative response to the treatment or the drug; and c) administering the treatment or the drug to the individual if the nucleic acid sample contains said biallelic marker associated with a positive response to the treatment or the drug or if the nucleic acid sample lacks said biallelic marker associated with a negative response to the treatment or the drug. In addition, the methods of the present invention for administering a drug or a treatment encompass methods with any further limitation described in this disclosure, or those following, specified alone or in any combination: optionally, said map-related biallelic marker may be in a sequence selected individually or in any combination from the group consisting of SEQ ID No. 1 to 3908, 1 to 2260, 2261 to 3734, 3734 to 3908 and the complements thereof; or optionally, the administering step comprises administering the drug or the treatment to the individual if the nucleic acid sample contains said biallelic marker associated with a positive response to the treatment or the drug and the nucleic acid sample lacks said biallelic marker associated with a negative response to the treatment or the drug.

A sixteenth embodiment of the present invention is a method of selecting an individual for inclusion in a clinical trial of a treatment or drug comprising the steps of: a) obtaining a nucleic acid sample from an individual; b) determining the identity of the polymorphic base of at least one map-related biallelic marker which is associated with a positive response to the treatment or the drug, or at least one map-related biallelic marker which is associated with a negative response to the treatment or the drug in the nucleic acid sample, and c) including the individual in the clinical trial if the nucleic acid sample contains said map-related biallelic marker associated with a positive response to the treatment or the drug or if the nucleic acid sample lacks said biallelic marker associated with a negative response to the treatment or the drug. In addition, the methods of the present invention for selecting an individual for inclusion in a clinical trial of a treatment or drug encompass methods with any further limitation described in this disclosure, or those following, specified alone or in any combination: optionally, said map-related biallelic marker may be in a sequence selected individually or in any combination from the group consisting of SEQ ID No. 1 to 3908, 1 to 2260, 2261 to 3734, 3734 to 3908 and the complements thereof; optionally, the including step comprises administering the drug or the treatment to the individual if the nucleic acid sample contains said biallelic marker associated with a positive response to the treatment or the drug and the nucleic acid sample lacks said biallelic marker associated with a negative response to the treatment or the drug.

A seventeenth embodiment of the present invention is a method of identifying a gene associated with a detectable trait comprising the steps of: a) selecting a gene suspected of being associated with a detectable trait; and b) identifying at least one map-related biallelic marker within said gene which is associated with said detectable trait. In addition, the methods of the present invention for identifying a gene associated with a detectable trait encompass methods with any further limitation described in this disclosure, or those following, specified alone or in any combination: optionally, said map-related biallelic marker may be in a sequence selected individually or in any combination from the group consisting of SEQ ID No. 1 to 3908, 1 to 2260, 2261 to 3734, 3734 to 3908 and the complements thereof; optionally, the identifying step comprises determining the frequencies of the map-related biallelic marker(s) in individuals who express said detectable trait and individuals who do not express said detectable trait and identifying one or more biallelic markers which are statistically associated with the expression of the detectable trait.

Additional embodiments are set forth in the Detailed Description of the Invention and in the Examples.

BRIEF DESCRIPTION OF THE DRAWINGS

FIG. 3 shows, for a series of hypothetical sample sizes, the p-value significance obtained in association studies performed using individual markers from the high-density biallelic map, according to various hypotheses regarding the difference of allelic frequencies between the trait-positive and trait-negative samples.

FIG. 7 is a haplotype analysis using biallelic markers in the Apo E region.

FIG. 12 is a haplotype analysis using the biallelic markers in the genomic region of the gene associated with prostate cancer.

FIG. 13 is a simulated haplotype using the six markers included in haplotype 5 of FIG. 12.

BRIEF DESCRIPTION OF THE SEQUENCE LISTINGS

Figure 1:
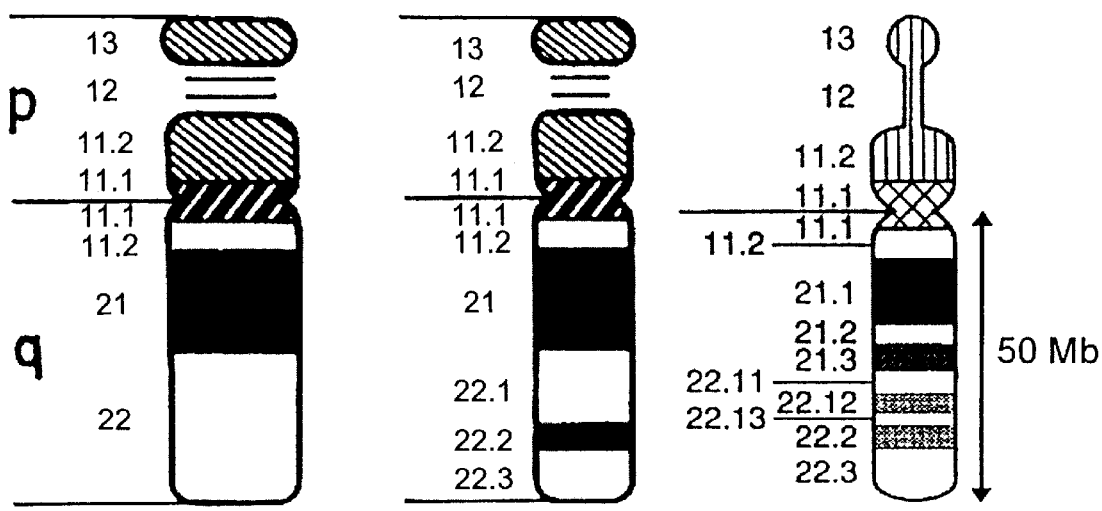
FIG. 1 is a cytogenetic map of chromosome 21.

SEQ ID Nos. 1 to 3908 contain nucleotide sequences comprising a portion of the map-related biallelic markers of the invention.

SEQ ID Nos. 3909 to 3934 contain nucleotide sequences comprising a portion of the map-related biallelic markers which are shown to be associated with Alzheimer's disease, prostate cancer or asthma as described in the Examples.

SEQ ID Nos. 3935 to 7842 contain nucleotide sequences of upstream amplification primers (PU) designed to amplify sequences containing the biallelic markers of SEQ ID Nos. 1 to 3908.

SEQ ID Nos. 7843 to 7865 contain nucleotide sequences of upstream amplification primers (PU) designed to amplify sequences containing the biallelic markers of SEQ ID Nos. 3909 to 3934.

SEQ ID Nos. 7866 to 11773 contain nucleotide sequences of downstream amplification primers (RP) designed to amplify sequences containing the biallelic markers of SEQ ID Nos. 1 to 3908.

SEQ ID Nos. 11774 to 11796 contain nucleotide sequences of downstream amplification primers (RP) designed to amplify sequences containing the biallelic markers of SEQ ID Nos. 3909 to 3934.

DETAILED DESCRIPTION OF THE EMBODIMENTS

Before describing the invention in greater detail, the following definitions are set forth to illustrate and define the meaning and scope of the terms used to describe the invention herein.

Definitions

As used interchangeably herein, the terms "nucleic acids" "oligonucleotides", and "polynucleotides" include RNA, DNA, or RNA/DNA hybrid sequences of more than one nucleotide in either single chain or duplex form. The term "nucleotide" as used herein as an adjective to describe molecules comprising RNA, DNA, or RNA/DNA hybrid sequences of any length in single-stranded or duplex form. The term "nucleotide" is also used herein as a noun to refer to individual nucleotides or varieties of nucleotides, meaning a molecule, or individual unit in a larger nucleic acid molecule, comprising a purine or pyrimidine, a ribose or deoxyribose sugar moiety, and a phosphate group, or phosphodiester linkage in the case of nucleotides within an oligonucleotide or polynucleotide. Although the term "nucleotide" is also used herein to encompass "modified nucleotides" which comprise at least one modifications (a) an alternative linking group, (b) an analogous form of purine, (c) an analogous form of pyrimidine, or (d) an analogous sugar, for examples of analogous linking groups, purine, pyrimidines, and sugars see for example PCT publication No. WO 95/04064. However, the polynucleotides of the invention are preferably comprised of greater than 50% conventional deoxyribose nucleotides, and most preferably greater than 90% conventional deoxyribose nucleotides. The polynucleotide sequences of the invention may be prepared by any known method, including synthetic, recombinant, ex vivo generation, or a combination thereof, as well as utilizing any purification methods known in the art.

The term "purified" is used herein to describe a polynucleotide or polynucleotide vector of the invention which has been separated from other compounds including, but not limited to other nucleic acids, carbohydrates, lipids and proteins (such as the enzymes used in the synthesis of the polynucleotide), or the separation of covalently closed polynucleotides from linear polynucleotides. A polynucleotide is substantially pure when at least about 50%, preferably 60 to 75% of a sample exhibits a single polynucleotide sequence and conformation (linear versus covalently close). A substantially pure polynucleotide typically comprises about 50%, preferably 60 to 90% weight/weight of a nucleic acid sample, more usually about 95%, and preferably is over about 99% pure. Polynucleotide purity or homogeneity may be indicated by a number of means well known in the art, such as agarose or polyacrylamide gel electrophoresis of a sample, followed by visualizing a single polynucleotide band upon staining the gel. For certain purposes higher resolution can be provided by using HPLC or other means well known in the art.

The term "primer" denotes a specific oligonucleotide sequence which is complementary to a target nucleotide sequence and used to hybridize to the target nucleotide sequence. A primer serves as an initiation point for nucleotide polymerization catalyzed by either DNA polymerase, RNA polymerase or reverse transcriptase.

The term "probe" denotes a defined nucleic acid segment (or nucleotide analog segment, e.g., polynucleotide as defined herein) which can be used to identify a specific polynucleotide sequence present in samples, said nucleic acid segment comprising a nucleotide sequence complementary of the specific polynucleotide sequence to be identified.

The terms "detectable trait" "trait" and "phenotype" are used interchangeably herein and refer to any visible, detectable or otherwise measurable property of an organism such as symptoms of, or susceptibility to a disease for example. Typically the terms "detectable trait" "trait" or "phenotype" are used herein to refer to symptoms of, or susceptibility to a disease; or to refer to an individual's response to an agent, drug, or treatment acting on a disease; or to refer to symptoms of, or susceptibility to side effects to an agent acting on a disease.

The term "treatment" is used herein to encompass any medical intervention known in the art including, for example, the administration of pharmaceutical agents, medically prescribed changes in diet, or habits such as a reduction in smoking or drinking, surgery, the application of medical devices, and the application or reduction of certain physical conditions, for example, light or radiation.

The term "allele" is used herein to refer to variants of a nucleotide sequence. A biallelic polymorphism has two forms; designated herein as the $1^{ST}$ allele and the $2^{ND}$ allele. Diploid organisms may be homozygous or heterozygous for an allelic form.

The term "heterozygosity rate" is used herein to refer to the incidence of individuals in a population, which are heterozygous at a particular allele. In a biallelic system the heterozygosity rate is on average equal to $2P_a(1-P_a)$, where $P_a$ is the frequency of the least common allele. In order to be useful in genetic studies a genetic marker should have an adequate level of heterozygosity to allow a reasonable probability that a randomly selected person will be heterozygous.

The term "genotype" as used herein refers the identity of the alleles present in an individual or a sample. In the context of the present invention a genotype preferably refers to the description of the biallelic marker alleles present in an individual or a sample. The term "genotyping" a sample or an individual for a biallelic marker consists of determining the specific allele or the specific nucleotide carried by an individual at a biallelic marker.

The term "mutation" as used herein refers to a difference in DNA sequence between or among different genomes or individuals which has a frequency below 1%.

The term "haplotype" refers to a combination of alleles present in an individual or a sample. In the context of the present invention a haplotype preferably refers to a combination of biallelic marker alleles found in a given individual and which may be associated with a phenotype.

The term "polymorphism" as used herein refers to the occurrence of two or more alternative genomic sequences or alleles between or among different genomes or individuals. "Polymorphic" refers to the condition in which two or more variants of a specific genomic sequence can be found in a population. A "polymorphic site" is the locus at which the variation occurs. A single nucleotide polymorphism is a single base pair change. Typically a single nucleotide polymorphism is the replacement of one nucleotide by another nucleotide at the polymorphic site. Deletion of a single nucleotide or insertion of a single nucleotide, also give rise to single nucleotide polymorphisms. In the context of the present invention "single nucleotide polymorphism" preferably refers to a single nucleotide substitution. Typically, between different genomes or between different individuals, the polymorphic site may be occupied by two different nucleotides.

The terms "biallelic polymorphism" and "biallelic marker" are used interchangeably herein to refer to a polymorphism having two alleles at a fairly high frequency in the population, preferably a single nucleotide polymorphism. A "biallelic marker allele" refers to the nucleotide variants present at a biallelic marker site. Typically the frequency of the less common allele of the biallelic markers of the present invention has been validated to be greater than 1%, preferably the frequency is greater than 10%, more preferably the frequency is at least 20% (i.e. heterozygosity rate of at least 0.32), even more preferably the frequency is at least 30% (i.e. heterozygosity rate of at least 0.42). A biallelic marker wherein the frequency of the less common allele is 30% or more is termed a "high quality biallelic marker."

The location of nucleotides in a polynucleotide with respect to the center of the polynucleotide are described herein in the following manner. When a polynucleotide has an odd number of nucleotides, the nucleotide at an equal distance from the 3' and 5' ends of the polynucleotide is considered to be "at the center" of the polynucleotide, and any nucleotide immediately adjacent to the nucleotide at the center, or the nucleotide at the center itself is considered to be "within 1 nucleotide of the center." With an odd number of nucleotides in a polynucleotide any of the five nucleotides positions in the middle of the polynucleotide would be considered to be within 2 nucleotides of the center, and so on. When a polynucleotide has an even number of nucleotides, there would be a bond and not a nucleotide at the center of the polynucleotide. Thus, either of the two central nucleotides would be considered to be "within 1 nucleotide of the center" and any of the four nucleotides in the middle of the polynucleotide would be considered to be "within 2 nucleotides of the center", and so on. For polymorphisms which involve the substitution, insertion or deletion of 1 or more nucleotides, the polymorphism, allele or biallelic marker is "at the center" of a polynucleotide if the difference between the distance from the substituted, inserted, or deleted polynucleotides of the polymorphism and the 3' end of the polynucleotide, and the distance from the substituted, inserted, or deleted polynucleotides of the polymorphism and the 5' end of the polynucleotide is zero or one nucleotide. If this difference is 0 to 3, then the polymorphism is considered to be "within 1 nucleotide of the center." If the difference is 0 to 5, the polymorphism is considered to be "within 2 nucleotides of the center." If the difference is 0 to 7, the polymorphism is considered to be "within 3 nucleotides of the center," and so on. For polymorphisms which involve the substitution, insertion or deletion of 1 or more nucleotides, the polymorphism, allele or biallelic marker is "at the center" of a polynucleotide if the difference between the distance from the substituted, inserted, or deleted polynucleotides of the polymorphism and the 3' end of the polynucleotide, and the distance from the substituted, inserted, or deleted polynucleotides of the polymorphism and the 5' end of the polynucleotide is zero or one nucleotide. If this difference is 0 to 3, then the polymorphism is considered to be "within 1 nucleotide of the center." If the difference is 0 to 5, the polymorphism is considered to be "within 2 nucleotides of the center." If the difference is 0 to 7, the polymorphism is considered to be "within 3 nucleotides of the center," and so on.

The term "upstream" is used herein to refer to a location which, is toward the 5' end of the polynucleotide from a specific reference point.

The terms "base paired" and "Watson & Crick base paired" are used interchangeably herein to refer to nucleotides which can be hydrogen bonded to one another be virtue of their sequence identities in a manner like that found in double-helical DNA with thymine or uracil residues linked to adenine residues by two hydrogen bonds and cytosine and guanine residues linked by three hydrogen bonds (See Stryer, L., *Biochemistry*, 4th edition, 1995).

The terms "complementary" or "complement thereof" are used herein to refer to the sequences of polynucleotides which is capable of forming Watson & Crick base pairing with another specified polynucleotide throughout the entirety of the complementary region. This term is applied to pairs of polynucleotides based solely upon their sequences and not any particular set of conditions under which the two polynucleotides would actually bind.

As used herein the term "map-related biallelic marker" relates to a biallelic marker in linkage disequilibrium with any of the sequences disclosed in SEQ ID Nos. 1 to 3908 which contain a biallelic marker of the map. The term map-related biallelic marker encompasses all of the biallelic markers disclosed in SEQ ID Nos. 1 to 3908, 1 to 2260, 2261 to 3374, 3735 to 3908. The preferred map-related biallelic marker alleles of the present invention include each one of the alleles selected individually or in any combination from the biallelic markers of SEQ ID Nos. 1 to 3908, 1 to 2260, 2261 to 3374, and 3735 to 3908, as identified in field <223> of the allele feature in the appended Sequence Listing, individually or in groups consisting of all the possible combinations of the alleles.

The terms "$1^{ST}$ allele" and "$2^{ND}$ allele" refer to the nucleotide located at the polymorphic base of a polynucleotide sequence containing a biallelic marker, as identified in field <222> of the allele feature in the appended Sequence Listing for each Sequence ID number. As used herein, the polymorphic base is located at nucleotide position 24 for each of SEQ ID Nos. 1 to 3908, with the exception of SEQ ID Nos. 914, 1013, 2544, 3434, 3795, and 3028. The polymorphic base is located at nucleotide position 23 for SEQ ID Nos. 914, 1013 and 2544, at nucleotide position 21 for SEQ ID No. 3028, at nucleotide position 20 for SEQ ID No. 3434.

I. Biallelic Markers And Polynucleotides Comprising Biallelic Markers Polynucleotides of the Present Invention The present invention encompasses polynucleotides for use as primers and probes in the methods of the invention. All of the polynucleotides of the invention may be specified as being isolated, purified or recombinant. These polynucleotides may consist of, consist essentially of, or comprise a contiguous span of nucleotides of a sequence from any sequence in the Sequence Listing as well as sequences which are complementary thereto ("complements thereof"). The "contiguous span" may be at least 8, 10, 12, 15, 18, 19, 20, 22, 23, 24, 25, 30, 35, 43, 44, 45, 46 or 47 nucleotides in length, to the extent that a contiguous span of these lengths is consistent with the lengths of the particular Sequence ID. It should be noted that the polynucleotides of the present invention are not limited to having the exact flanking sequences surrounding the polymorphic bases which are enumerated in the Sequence Listing. Rather, it will be appreciated that the flanking sequences surrounding the biallelic markers, or any of the primers of probes of the invention which, are more distant from the markers, may be lengthened or shortened to any extent compatible with their intended use and the present invention specifically contemplates such sequences. It will be appreciated that the polynucleotides referred to in the Sequence Listing may be of any length compatible with their intended use. Also the flanking regions outside of the contiguous span need not be homologous to native flanking sequences which actually occur in human subjects. The addition of any nucleotide sequence, which is compatible with the nucleotides intended use is specifically contemplated. The contiguous span may optionally include the map-related biallelic marker in said sequence. Biallelic markers generally consist of a polymorphism at one single base position. Each biallelic marker therefore corresponds to two forms of a polynucleotide sequence which, when compared with one another, present a nucleotide modification at one position. Usually, the nucleotide modification involves the substitution of one nucleotide for another. Optionally either the $1^{ST}$ allele or the $2^{ND}$ allele of the biallelic markers of SEQ ID Nos. 1 to 3908, 1 to 2260, 2261 to 3374, and 3735 to 3908 may be specified as being present at the map-related biallelic marker.

Preferred polynucleotides may consist of, consist essentially of, or comprise a contiguous span of nucleotides of a sequence from SEQ ID Nos. 1 to 2260 as well as sequences which are complementary thereto. The "contiguous span" may be at least 8, 10, 12, 15, 18, 19, 20, 22, 23, 24, 25, 30, 35, 43, 44, 45, 46 or 47 nucleotides in length, to the extent that a contiguous span of these lengths is consistent with the lengths of the particular Sequence ID. Particularly preferred are polynucleotides which consist of, consist essentially of, or comprise a contiguous span of nucleotides of a sequence of any of SEQ ID Nos. 1 to 2260, or the complements thereof, wherein the $1^{ST}$ allele of the biallelic marker of the SEQ ID No. is present at the map-related biallelic marker. Other preferred polynucleotides consist of, consist essentially of, or comprise a contiguous span of nucleotides of any of SEQ ID Nos. 1 to 2260, or the complements thereof, wherein the $2^{ND}$ allele of the biallelic marker of the SEQ ID No. is present at the map-related biallelic marker. Preferred polynucleotides may consist of, consist essentially of, or comprise a contiguous span of at least 8, 10, 12, 15, 18, 19, 20, 22, 23, 24, 25, 30, 35, 43, 44, 45, 46 or 47 nucleotides in length, to the extent that a contiguous span of these lengths is consistent with the lengths of the particular Sequence ID No., of a sequence from SEQ ID Nos. 2261 to 3734 as well as sequences which are complementary thereto. Particularly preferred are polynucleotides which consist of, consist essentially of, or comprise a contiguous span of nucleotides of a sequence of any of SEQ ID Nos. 2261 to 3734, or the complements thereof, wherein the $1^{ST}$ allele of the biallelic marker of the SEQ ID No. is present at the map-related biallelic marker. Other preferred polynucleotides consist of, consist essentially of, or comprise a contiguous span of nucleotides of any of SEQ ID Nos. 2261 to 3734, or the complements thereof, wherein the $2^{ND}$ allele of the biallelic marker of the SEQ ID No. is present at the map-related biallelic marker. Preferred polynucleotides may consist of, consist essentially of, or comprise a contiguous span of at least 8, 10, 12, 15, 18, 19, 20, 22, 23, 24, 25, 30, 35, 43, 44, 45, 46 or 47 nucleotides in length, to the extent that a contiguous span of these lengths is consistent with the lengths of the particular Sequence ID No., of a sequence from SEQ ID Nos. 3735 to 3908 as well as sequences which are complementary thereto. Particularly preferred are polynucleotides which consist of, consist essentially of, or comprise a contiguous span of nucleotides of a sequence of any of SEQ ID Nos. 3735 to 3908, or the complements thereof, wherein the $1^{ST}$ allele of the biallelic marker of the SEQ ID No. is present at the map-related biallelic marker. Other preferred polynucleotides consist of, consist essentially of, or comprise a contiguous span of nucleotides of any of SEQ ID Nos. 3735 to 3908, or the complements thereof, wherein the $2^{ND}$ allele of the biallelic marker of the SEQ ID No. is present at the map-related biallelic marker. Also encompassed by the polynucleotides of the present invention are polynucleotides which consist of, consist essentially of, or comprise a contiguous span at least 8, 10, 12, 15, 18, 19, 20, 22, 23, 24, 25, 30, 35, 43, 44, 45, 46 or 47 nucleotides in length, to the extent that a contiguous span of these lengths is consistent with the lengths of the particular Sequence ID, of a sequence from SEQ ID Nos. 1201, 3242, 3907 and 3908 as well as sequences which are complementary thereto, wherein said contiguous span of SEQ ID Nos. 1201 or 3242 contains a "G" at the polymorphic base, or wherein said contiguous span of SEQ ID Nos. 3907 or 3908 contain an "A" at the polymorphic base.

The present invention also relates to a biallelic marker or set of biallelic markers of the invention comprising:

(a) at least one of SEQ ID Nos. 583, 620, 1277 to 1279, 1281, 1375 to 1377, 1379 to 1382, 1676 to 1681, 3106, 3547, 3548, 3889; and/or (b) at least one of SEQ ID Nos. 86, 105, 109, 110, 185, 284, 381, 414, 428, 441, 445, 446, 453, 464, 467, 487, 489, 520, 3915 to 3918, 3920, and 3923 to 3926; and/or (c) at least one of SEQ ID Nos. 232 to 237, 340, 346, and 3927–3934; and/or (d) at least one of SEQ ID Nos. 607, 616, 619, 623, 626, 627, 645, 646, 650, 651, 1899 and 2721; and/or (e) at least one of SEQ ID Nos. 2694 to 2697, 3494 to 3496 and 3882; and/or (f) at least one of SEQ ID Nos. 204, 205, 225, 273, 274, 1723, 1732, 1743.

Thus, in said embodiment, the polynucleotides and nucleic acid codes of the invention may comprise a nucleotide sequence or group of nucleotide sequences of said SEQ ID numbers listed above in (a) to (f), the amplification primers related to said SEQ ID Numbers, as described in Table 1, and the sequences complementary thereto. Optionally, any biallelic markers, sets of biallelic markers, polynucleotides or nucleic acid codes described throughout the present specification may be selected from a group specifically excluding one or more of said SEQ ID numbers listed above in (a) to (f). The biallelic markers, sets of biallelic markers, polynucleotides or nucleic acid codes of the invention may be selected from a group which specifically excludes one or more of said SEQ ID numbers listed above in (a) to (f) individually or in any combination.

The invention also relates to polynucleotides that hybridize, under conditions of high or intermediate stringency, to a polynucleotide of a sequence from any of SEQ ID Nos. 1 to 3908, 1 to 2260, 2261 to 3374, and 3735 to 3908 as well as sequences which are complementary thereto. Preferably such polynucleotides are at least 8, 10, 12, 15, 18, 19, 20, 22, 23, 24, 25, 30, 35, 43, 44, 45, 46 or 47 nucleotides in length, to the extent that a polynucleotide of these lengths is consistent with the lengths of the particular Sequence ID. Preferred polynucleotides comprise a map-related biallelic marker. Optionally either the $1^{ST}$ or the $2^{ND}$ allele of the biallelic markers disclosed in the SEQ ID No. may be specified as being present at the map-related biallelic marker. Conditions of high and intermediate stringency are further described in III.C.4.

The primers of the present invention may be designed from the disclosed sequences using any method known in the art. A preferred set of primers is fashioned such that the 3' end of the contiguous span of identity with the sequences of the Sequence Listing is present at the 3' end of the primer. Such a configuration allows the 3' end of the primer to hybridize to a selected nucleic acid sequence and dramatically increases the efficiency of the primer for amplification or sequencing reactions.

In a preferred set of primers, the contiguous span is found in one of the sequences described in SEQ ID Nos. 1 to 3908, 1 to 2260, 2261 to 3374, 3735 to 3908, 3935 to 7842, 3935 to 6194, 6195 to 7668, 7669 to 7842, 7866 to 11773, 7866 to 10125, 10126 to 11599, and 11600 to 11773 or the complements thereof. The invention also relates to polynucleotides consisting of, consisting essentially of, or comprising a contiguous span of nucleotides of a sequence from SEQ ID Nos. 3935 to 7842, 3935 to 6194, 6195 to 7668, 7669 to 7842, 7866 to 11773, 7866 to 10125, 10126 to 11599, and 11600 to 11773, as well as sequences which are complementary thereto, wherein the "contiguous span" may be at least 8, 10, 12, 15, 18, 19, 20, or 21 nucleotides in length, to the extent that a contiguous span of these lengths is consistent with the lengths of the particular Sequence ID No.

Allele specific primers may be designed such that a biallelic marker is at the 3' end of the contiguous span and the contiguous span is present at the 3' end of the primer. Such allele specific primers tend to selectively prime an amplification or sequencing reaction so long as they are used with a nucleic acid sample that contains one of the two alleles present at a biallelic marker. The 3' end of primer of the invention may be located within or at least 2, 4, 6, 8, 10, to the extent that this distance is consistent with the particular Sequence ID, nucleotides upstream of a map-related biallelic marker in said sequence or at any other location which is appropriate for their intended use in sequencing, amplification or the location of novel sequences or markers. Primers with their 3' ends located 1 nucleotide upstream of a map-related biallelic marker have a special utility as microsequencing assays. Preferred microsequencing primers are described in SEQ ID Nos. 1 to 3908, 1 to 2260, 2261 to 3374, and 3735 to 3908, where for each of SEQ ID Nos. 1 to 3908, 1 to 2260, 2261 to 3374, and 3735 to 3908, the sense microsequencing primer contains the complement of the 19 nucleotides having their 3' ends located 1 nucleotide upstream of the polymorphic base of the respective SEQ ID No, and where the antisense microsequencing primer contains the complement of the 19 nucleotides of the complementary strand, nucleotides of the primer having their 3' end located 1 nucleotide upstream of the polymorphic base on the complementary strand to the respective SEQ ID No. The most preferred of said microsequencing primers for each of SEQ ID Nos. 1 to 3908, 1 to 2260, 2261 to 3374, and 3735 to 3908 are microsequencing primers indicated as "A" or "S" in Table 1, which have been validated in microsequencing experiments.

The probes of the present invention may be designed from the disclosed sequences for any method known in the art, particularly methods which allow for testing if a particular sequence or marker disclosed herein is present. A preferred set of probes may be designed for use in the hybridization assays of the invention in any manner known in the art such that they selectively bind to one allele of a biallelic marker, but not the other under any particular set of assay conditions. Preferred hybridization probes may consist of, consist essentially of, or comprise a contiguous span of SEQ ID Nos. 1 to 3908, 1 to 2260, 2261 to 3374, and 3735 to 3908, or the complement thereof, which ranges in length from least 8, 10, 12, 15, 18, 19, 20, 22, 23, 24, 25, 30, 35, 43, 44, 45, 46 or 47 nucleotides, to the extent that a contiguous span of these lengths is consistent with the lengths of the particular Sequence ID No., or be specified as being 12, 15, 18, 19, 20, 25, 35, 40, 43, 44, 45, 46 or 47 nucleotides in length and including the map-related biallelic marker of said sequence. Optionally the 1 st allele or 2nd allele of SEQ ID Nos. 1 to 3908, 1 to 2260, 2261 to 3374, and 3735 to 3908 may be specified as being present at the biallelic marker site. Optionally, said biallelic marker may be within 6, 5, 4, 3, 2, or 1 nucleotides of the center of the hybridization probe or at the center of said probe.

Any of the polynucleotides of the present invention can be labeled, if desired, by incorporating a label detectable by spectroscopic, photochemical, biochemical, immunochemical, or chemical means. For example, useful labels include radioactive substances, fluorescent dyes or biotin. Preferably, polynucleotides are labeled at their 3' and 5' ends. A label can also be used to capture the primer, so as to facilitate the immobilization of either the primer or a primer extension product, such as amplified DNA, on a solid support. A capture label is attached to the primers or probes and can be a specific binding member which forms a binding pair with the solid's phase reagent's specific binding member (e.g. biotin and streptavidin). Therefore depending upon the type of label carried by a polynucleotide or a probe, it may be employed to capture or to detect the target DNA. Further, it will be understood that the polynucleotides, primers or probes provided herein, may, themselves, serve as the capture label. For example, in the case where a solid phase reagent's binding member is a nucleic acid sequence, it may be selected such that it binds a complementary portion of a primer or probe to thereby immobilize the primer or probe to the solid phase. In cases where a polynucleotide probe itself serves as the binding member, those skilled in the art will recognize that the probe will contain a sequence or "tail" that is not complementary to the target. In the case where a polynucleotide primer itself serves as the capture label, at least a portion of the primer will be free to hybridize with a nucleic acid on a solid phase. DNA Labeling techniques are well known to the skilled technician.

Any of the polynucleotides, primers and probes of the present invention can be conveniently immobilized on a solid support. Solid supports are known to those skilled in the art and include the walls of wells of a reaction tray, test tubes, polystyrene beads, magnetic beads, nitrocellulose strips, membranes, microparticles such as latex particles, sheep (or other animal) red blood cells, duracytes® and others. The solid support is not critical and can be selected by one skilled in the art. Thus, latex particles, microparticles, magnetic or non-magnetic beads, membranes, plastic tubes, walls of microtiter wells, glass or silicon chips, sheep (or other suitable animal's) red blood cells and duracytes are all suitable examples. Suitable methods for immobilizing nucleic acids on solid phases include ionic, hydrophobic, covalent interactions and the like. A solid support, as used herein, refers to any material which is insoluble, or can be made insoluble by a subsequent reaction. The solid support can be chosen for its intrinsic ability to attract and immobilize the capture reagent. Alternatively, the solid phase can retain an additional receptor which has the ability to attract and immobilize the capture reagent. The additional receptor can include a charged substance that is oppositely charged with respect to the capture reagent itself or to a charged substance conjugated to the capture reagent. As yet another alternative, the receptor molecule can be any specific binding member which is immobilized upon (attached to) the solid support and which has the ability to immobilize the capture reagent through a specific binding reaction. The receptor molecule enables the indirect binding of the capture reagent to a solid support material before the performance of the assay or during the performance of the assay. The solid phase thus can be a plastic, derivatized plastic, magnetic or non-magnetic metal, glass or silicon surface of a test tube, microtiter well, sheet, bead, microparticle, chip, sheep (or other suitable animal's) red blood cells, duracytes® and other configurations known to those of ordinary skill in the art. The polynucleotides of the invention can be attached to or immobilized on a solid support individually or in groups of at least 2, 5, 8, 10, 12, 15, 20, or 25 distinct polynucleotides of the inventions to a single solid support. In addition, polynucleotides other than those of the invention may attached to the same solid support as one or more polynucleotides of the invention.

Any polynucleotide provided herein may be attached in overlapping areas or at random locations on the solid support. Alternatively the polynucleotides of the invention may be attached in an ordered array wherein each polynucleotide is attached to a distinct region of the solid support which does not overlap with the attachment site of any other polynucleotide. Preferably, such an ordered array of polynucleotides is designed to be "addressable" where the distinct locations are recorded and can be accessed as part of an assay procedure. Addressable polynucleotide arrays typically comprise a plurality of different oligonucleotide probes that are coupled to a surface of a substrate in different known locations. The knowledge of the precise location of each polynucleotides location makes these "addressable" arrays particularly useful in hybridization assays. Any addressable array technology known in the art can be employed with the polynucleotides of the invention. One particular embodiment of these polynucleotide arrays is known as the Genechips™, and has been generally described in U.S. Pat. No. 5,143,854; PCT publications WO 90/15070 and 92/10092, the disclosures of which are incorporated herein by reference in their entireties. These arrays may generally be produced using mechanical synthesis methods or light directed synthesis methods, which incorporate a combination of photolithographic methods and solid phase oligonucleotide synthesis (Fodor et al., Science, 251:767–777, 1991, the disclosure of which is incorporated herein by reference in its entirety). The immobilization of arrays of oligonucleotides on solid supports has been rendered possible by the development of a technology generally identified as "Very Large Scale Immobilized Polymer Synthesis" (VLSIPS™) in which, typically, probes are immobilized in a high density array on a solid surface of a chip. Examples of VLSIPS™ technologies are provided in U.S. Pat. Nos. 5,143,854 and 5,412,087 and in PCT Publications WO 90/15070, WO 92/10092 and WO 95/11995, the disclosures of which are incorporated herein by reference in their entirety, which describe methods for forming oligonucleotide arrays through techniques such as light-directed synthesis techniques. In designing strategies aimed at providing arrays of nucleotides immobilized on solid supports, further presentation strategies were developed to order and display the oligonucleotide arrays on the chips in an attempt to maximize hybridization patterns and sequence information. Examples of such presentation strategies are disclosed in PCT Publications WO 94/12305, WO 94/11530, WO 97/29212 and WO 97/31256, the disclosures of which are incorporated herein by reference in their entireties.

Oligonucleotide arrays may comprise at least one of the sequences selected from the group consisting of SEQ ID Nos. 1 to 3908, 1 to 2260, 2261 to 3374, and 3735 to 3908 and the sequences complementary thereto, or a fragment thereof of at least 8, 10, 12, 15, 18, 19, 20, 22, 23, 24, 25, 30, 35, 43, 44, 45, 46 or 47 consecutive nucleotides, to the extent that fragments of these lengths is consistent with the lengths of the particular Sequence ID, for determining whether a sample contains one or more alleles of the biallelic markers of the present invention. Oligonucleotide arrays may also comprise at least one of the sequences selected from the group consisting of SEQ ID Nos. 1 to 3908, 1 to 2260, 2261 to 3374, and 3735 to 3908, and the sequences complementary thereto, or a fragment thereof of at least 8, 10, 12, 15, 18, 19, 20, 22, 23, 24, 25, 30, 35, 43, 44, 45, 46 or 47 consecutive nucleotides, to the extent that fragments of these lengths is consistent with the lengths of the particular Sequence ID, for amplifying one or more alleles of the biallelic markers of SEQ ID Nos. 1 to 3908, 1 to 2260, 2261 to 3374, and 3735 to 3908. In other embodiments, arrays may also comprise at least one of the sequences selected from the group consisting of SEQ ID Nos. 1 to 3908, 1 to 2260, 2261 to 3374, and 3735 to 3908 and the sequences complementary thereto, or a fragment thereof of at 8, 10, 12, 15, 18, 19, 20, 22, 23, 24, 25, 30, 35, 43, 44, 45, 46 or 47 consecutive nucleotides, to the extent that fragments of these lengths is consistent with the lengths of the particular Sequence ID, for conducting microsequencing analyses to determine whether a sample contains one or more alleles of the biallelic markers of the invention. In still further embodiments, the oligonucleotide array may comprise at least one of the sequences selected from the group consisting of SEQ ID Nos. 1 to 3908, 1 to 2260, 2261 to 3374, and 3735 to 3908 and the sequences complementary thereto, or a fragment thereof of at least 8, 10, 12, 15, 18, 19, 20, 22, 23, 24, 25, 30, 35, 43, 44, 45, 46 or 47 nucleotides in length, to the extent that fragments of these lengths is consistent with the lengths of the particular Sequence ID, for determining whether a sample contains one or more alleles of the biallelic markers of the present invention.

In designing strategies aimed at providing arrays of nucleotides immobilized on solid supports, further presentation strategies were developed to order and display the probe arrays on the chips in an attempt to maximize hybridization patterns and sequence information. Examples of such presentation strategies are disclosed in PCT Publications WO 94/12305, WO 94/11530, WO 97/29212 and WO 97/31256, the disclosures of which are incorporated herein by reference in their entireties.

Each DNA chip can contain thousands to millions of individual synthetic DNA probes arranged in a grid-like pattern and miniaturized to the size of a dime. In some embodiments, the efficiency of hybridization of nucleic acids in the sample with the probes attached to the chip may be improved by using polyacrylamide gel pads isolated from one another by hydrophobic regions in which the DNA probes are covalently linked to an acrylamide matrix.

The polymorphic bases present in the biallelic marker or markers of the sample nucleic acids are determined as follows. Probes which contain at least a portion of one or more of the biallelic markers of the present invention are synthesized either in situ or by conventional synthesis and immobilized on an appropriate chip using methods known to the skilled technician.

Any one or more alleles of the biallelic markers described herein (SEQ ID Nos. 1 to 3908, 1 to 2260, 2261 to 3374, 3735 to 3908 or the sequences complementary thereto) or fragments thereof containing the polymorphic bases, may be fixed to a solid support, such as a microchip or other immobilizing surface. The fragments of these nucleic acids may comprise at least 10, at least 15, at least 20, at least 25, or more than 25 consecutive nucleotides of the biallelic markers described herein. Preferably, the fragments include the polymorphic bases of the biallelic markers.

A nucleic acid sample is applied to the immobilizing surface and analyzed to determine the identities of the polymorphic bases of one or more of the biallelic markers. In some embodiments, the solid support may also include one or more of the amplification primers described herein, or fragments comprising at least 10, at least 15, or at least 20 consecutive nucleotides thereof, for generating an amplification product containing the polymorphic bases of the biallelic markers to be analyzed in the sample.

Another embodiment of the present invention is a solid support which includes one or more of the microsequencing primers of the invention, or fragments comprising at least 10, at least 15, or at least 20 consecutive nucleotides thereof and having a 3' terminus immediately upstream of the polymorphic base of the corresponding biallelic marker, for determining the identity of the polymorphic base of the one or more biallelic markers fixed to the solid support.

For example, one embodiment of the present invention is an array of nucleic acids fixed to a solid support, such as a microchip, bead, or other immobilizing surface, comprising one or more of the biallelic markers in the maps of the present invention or a fragment comprising at least 10, at least 15, at least 20, at least 25, or more than 25 consecutive nucleotides thereof including the polymorphic base. For example, the array may comprise 1, 5, 10, 20, 50, 100, 200, 500, 1000, 2000, or 3000 of the biallelic markers selected from the group consisting of SEQ ID Nos.: 1 to 3908, 1 to 2260, 2261 to 3374, 3735 to 3908 or the sequences complementary thereto, or a fragment comprising at least 10, at least 15, at least 20, at least 25, or more than 25 consecutive nucleotides thereof including the polymorphic base.

Another embodiment of the present invention is an array comprising amplification primers for generating amplification products containing the polymorphic bases of one or more, at least five, at least 10, at least 20, at least 100, at least 200, at least 300, at least 400, or more than 400 of the biallelic markers in the maps of the present invention. For example, the array may comprise amplification primers for generating amplification products containing the polymorphic bases of at least 1,5, 10, 20, 50, 100, 200, 300, 400, 500, 1000, 2000, or 3000, of the biallelic markers selected from the group consisting of SEQ ID Nos.: 1 to 3908, 1 to 2260, 2261 to 3374, 3735 to 3908 or the sequences complementary thereto. In such arrays, the amplification primers included in the array are capable of amplifying the biallelic marker sequences to be detected in the nucleic acid sample applied to the array (i.e. the amplification primers correspond to the biallelic markers affixed to the array—see Table 1). Thus, the arrays may include one or more of the amplification primers of SEQ ID Nos.: 3935 to 7842, 7866 to 11773, 3935 to 6194, 6195 to 7668, 7669 to 7842, 7866 to 10125, 10126 to 11599, and 11600 to 11773 corresponding to the one or more biallelic markers of SEQ ID Nos. 1 to 3908, 1 to 2260, 2261 to 3374, and 3735 to 3908 which are included in the array.

Another embodiment of the present invention is an array which includes microsequencing primers capable of determining the identity of the polymorphic bases of at least 1, 5, 10, 20, 50, 100, 200, 300, 500, 1000, 2000, or 3000 of the present invention. For example, the array may comprise microsequencing primers capable of determining the identity of the polymorphic bases of one or more, at least five, at least 10, at least 20, at least 100, at least 200, at least 300, at least 400, or more than 400 of the biallelic markers of SEQ ID Nos. 1 to 3908, 1 to 2260, 2261 to 3374, 3735 to 3908 or the sequences complementary thereto.

Arrays containing any combination of the above nucleic acids which permits the specific detection or identification of the polymorphic bases of the biallelic markers in the maps of the present invention, including any combination of biallelic markers of SEQ ID Nos. 1 to 3908, 1 to 2260, 2261 to 3374, 3735 to 3908 or the sequences complementary thereto are also within the scope of the present invention. For example, the array may comprise both the biallelic markers and amplification primers capable of generating amplification products containing the polymorphic bases of the biallelic markers. Alternatively, the array may comprise both amplification primers capable of generating amplification products containing the polymorphic bases of the biallelic markers and microsequencing primers capable of determining the identities of the polymorphic bases of these markers.

Although the above examples describe arrays comprising specific groups of biallelic markers and, in some embodiments, specific amplification primers and microsequencing primers, it will be appreciated that the present invention encompasses arrays including any biallelic marker, group of biallelic markers, amplification primer, group of amplification primers, microsequencing primer, or group of amplification primers described herein, as well as any combination of the preceding nucleic acids.

The present invention also encompasses diagnostic kits comprising one or more polynucleotides of the invention, optionally with a portion or all of the necessary reagents and instructions for genotyping a test subject by determining the identity of a nucleotide at a map-related biallelic marker. The polynucleotides of a kit may optionally be attached to a solid support, or be part of an array or addressable array of polynucleotides. The kit may provide for the determination of the identity of the nucleotide at a marker position by any method known in the art including, but not limited to, a sequencing assay method, a microsequencing assay method, a hybridization assay method, or an allele specific amplification method. Optionally,such a kit may include instructions for scoring the results of the determination with respect to the test subjects' risk of contracting a diseases involving a disease, likely response to an agent acting on a disease, or chances of suffering from side effects to an agent acting on a disease.

II. Methods For De Novo Identification Of Biallelic Markers

Any of a variety of methods can be used to screen a genomic fragment for single nucleotide polymorphisms such as differential hybridization with oligonucleotide probes, detection of changes in the mobility measured by gel electrophoresis or direct sequencing of the amplified nucleic acid. A preferred method for identifying biallelic markers involves comparative sequencing of genomic DNA fragments from an appropriate number of unrelated individuals.

In a first embodiment, DNA samples from unrelated individuals are pooled together, following which the genomic DNA of interest is amplified and sequenced. The nucleotide sequences thus obtained are then analyzed to identify significant polymorphisms. One of the major advantages of this method resides in the fact that the pooling of the DNA samples substantially reduces the number of DNA amplification reactions and sequencing reactions, which must be carried out. Moreover, this method is sufficiently sensitive so that a biallelic marker obtained thereby usually demonstrates a sufficient frequency of its less common allele to be useful in conducting association studies. Usually, the frequency of the least common allele of a biallelic marker identified by this method is at least 10%.

In a second embodiment, the DNA samples are not pooled and are therefore amplified and sequenced individually. This method is usually preferred when biallelic markers need to be identified in order to perform association studies within candidate genes. Preferably, highly relevant gene regions such as promoter regions or exon regions may be screened for biallelic markers. A biallelic marker obtained using this method may show a lower degree of informativeness for conducting association studies, e.g. if the frequency of its less frequent allele may be less than about 10%. Such a biallelic marker will however be sufficiently informative to conduct association studies and it will further be appreciated that including less informative biallelic markers in the genetic analysis studies of the present invention, may allow in some cases the direct identification of causal mutations, which may, depending on their penetrance, be rare mutations.

The following is a description of the various parameters of a preferred method used by the inventors for the identification of the biallelic markers of the present invention.

II.A. Genomic DNA Samples

The genomic DNA samples from which the biallelic markers of the present invention are generated are preferably obtained from unrelated individuals corresponding to a heterogeneous population of known ethnic background. The number of individuals from whom DNA samples are obtained can vary substantially, preferably from about 10 to about 1000, more preferably from about 50 to about 200 individuals. Usually, DNA samples are collected from at least about 100 individuals in order to have sufficient polymorphic diversity in a given population to identify as many markers as possible and to generate statistically significant results.

As for the source of the genomic DNA to be subjected to analysis, any test sample can be foreseen without any particular limitation. These test samples include biological samples, which can be tested by the methods of the present invention described herein, and include human and animal body fluids such as whole blood, serum, plasma, cerebrospinal fluid, urine, lymph fluids, and various external secretions of the respiratory, intestinal and genitourinary tracts, tears, saliva, milk, white blood cells, myelomas and the like; biological fluids such as cell culture supernatants; fixed tissue specimens including tumor and non-tumor tissue and lymph node tissues; bone marrow aspirates and fixed cell specimens. The preferred source of genomic DNA used in the present invention is from peripheral venous blood of each donor. Techniques to prepare genomic DNA from biological samples are well known to the skilled technician. Details of a preferred embodiment are provided in Example 27. The person skilled in the art can choose to amplify pooled or unpooled DNA samples.

II.B. DNA Amplification

The identification of biallelic markers in a sample of genomic DNA may be facilitated through the use of DNA amplification methods. DNA samples can be pooled or unpooled for the amplification step. DNA amplification techniques are well known to those skilled in the art. Various methods to amplify DNA fragments carrying biallelic markers are further described hereinafter in III.B. The PCR technology is the preferred amplification technique used to identify new biallelic markers.

In a first embodiment, biallelic markers are identified using genomic sequence information generated by the inventors. Genomic DNA fragments, such as the inserts of the BAC clones described above, are sequenced and used to design primers for the amplification of 500 bp fragments. These 500 bp fragments are amplified from genomic DNA and are scanned for biallelic markers. Primers may be designed using the OSP software (Hillier L. and Green P., 1991, the entire disclosure of which is incorporated by reference herein in its entirety). All primers may contain, upstream of the specific target bases, a common oligonucleotide tail that serves as a sequencing primer. Those skilled in the art are familiar with primer extensions, which can be used for these purposes.

In another embodiment of the invention, genomic sequences of candidate genes are available in public databases allowing direct screening for biallelic markers. Preferred primers, useful for the amplification of genomic sequences encoding the candidate genes, focus on promoters, exons and splice sites of the genes. A biallelic marker present in these functional regions of the gene have a higher probability to be a causal mutation.

Preferred primers include those disclosed in SEQ ID Nos. 3935 to 7842, 3935 to 6194, 6195 to 7668, 7669 to 7842, 7866 to 11773, 7866 to 10125, 10126 to 11599, and 11600 to 11773.

II.C. Sequencing Of Amplified Genomic DNA And Identification Of Single Nucleotide Polymorphisms The amplification products generated as described above, are then sequenced using any method known and available to the skilled technician. Methods for sequencing DNA using either the dideoxy-mediated method (Sanger method) or the Maxam-Gilbert method are widely known to those of ordinary skill in the art. Such methods are for example disclosed in Maniatis et al. (Molecular Cloning, A Laboratory Manual, Cold Spring Harbor Press, Second Edition, 1989 the disclosure of which is incorporated herein by reference in its entirety). Alternative approaches include hybridization to high-density DNA probe arrays as described in Chee et al. (Science 274, 610, 1996, the disclosure of which is incorporated herein by reference in its entirety).

Preferably, the amplified DNA is subjected to automated dideoxy terminator sequencing reactions using a dye-primer cycle sequencing protocol. The products of the sequencing reactions are run on sequencing gels and the sequences are determined using gel image analysis. The polymorphism search is based on the presence of superimposed peaks in the electrophoresis pattern resulting from different bases occurring at the same position. Because each dideoxy terminator is labeled with a different fluorescent molecule, the two peaks corresponding to a biallelic site present distinct colors corresponding to two different nucleotides at the same position on the sequence. However, the presence of two peaks can be an artifact due to background noise. To exclude such an artifact, the two DNA strands are sequenced and a comparison between the peaks is carried out. In order to be registered as a polymorphic sequence, the polymorphism has to be detected on both strands.

The above procedure permits those amplification products, which contain biallelic markers to be identified.

The detection limit for the frequency of biallelic polymorphisms detected by sequencing pools of 100 individuals is approximately 0.1 for the minor allele, as verified by sequencing pools of known allelic frequencies. However, more than 90% of the biallelic polymorphisms detected by the pooling method have a frequency for the minor allele higher than 0.25. Therefore, the biallelic markers selected by this method have a frequency of at least 0.1 for the minor allele and less than 0.9 for the major allele. Preferably at least 0.2 for the minor allele and less than 0.8 for the major allele, more preferably at least 0.3 for the minor allele and less than 0.7 for the major allele, thus a heterozygosity rate higher than 0.18, preferably higher than 0.32, more preferably higher than 0.42.

In another embodiment, biallelic markers are detected by sequencing individual DNA samples, the frequency of the minor allele of such a biallelic marker may be less than 0.1.

The markers carried by the same fragment of genomic DNA, such as the insert in a BAC clone, need not necessarily be ordered with respect to one another within the genomic fragment to conduct association studies. However, in some embodiments of the present invention, the order of biallelic markers carried by the same fragment of genomic DNA are determined.

II.D. Validation of the Biallelic Markers of the Present Invention

The polymorphisms are evaluated for their usefulness as genetic markers by validating that both alleles are present in a population. Validation of the biallelic markers is accomplished by genotyping a group of individuals by a method of the invention and demonstrating that both alleles are present. Microsequencing is a preferred method of genotyping alleles. The validation by genotyping step may be performed on individual samples derived from each individual in the group or by genotyping a pooled sample derived from more than one individual. The group can be as small as one individual if that individual is heterozygous for the allele in question. Preferably the group contains at least three individuals, more preferably the group contains five or six individuals, so that a single validation test will be more likely to result in the validation of more of the biallelic markers that are being tested. It should be noted, however, that when the validation test is performed on a small group it may result in a false negative result if as a result of sampling error none of the individuals tested carries one of the two alleles. Thus, the validation process is less useful in demonstrating that a particular initial result is an artifact, than it is at demonstrating that there is a bonafide biallelic marker at a particular position in a sequence. All of the genotyping, haplotyping, association, and interaction study methods of the invention may optionally be performed solely with validated biallelic markers.

II.E. Evaluation of the Frequency of the Biallelic Markers of the Present Invention The validated biallelic markers are further evaluated for their usefulness as genetic markers by determining the frequency of the least common allele at the biallelic marker site. The determination of the least common allele is accomplished by genotyping a group of individuals by a method of the invention and demonstrating that both alleles are present. This determination of frequency by genotyping step may be performed on individual samples derived from each individual in the group or by genotyping a pooled sample derived from more than one individual. The group must be large enough to be representative of the population as a whole. Preferably the group contains at least 20 individuals, more preferably the group contains at least 50 individuals, most preferably the group contains at least 100 individuals. Of course the larger the group the greater the accuracy of the frequency determination because of reduced sampling error. A biallelic marker wherein the frequency of the less common allele is 30% or more is termed a "high quality biallelic marker." All of the genotyping, haplotyping, association, and interaction study methods of the invention may optionally be performed solely with high quality biallelic markers.

III. Methods Of Genotyping An Individual For Biallelic Markers

Methods are provided to genotype a biological sample for one or more biallelic markers of the present invention, all of which may be performed in vitro. Such methods of genotyping comprise determining the identity of a nucleotide at a map-related biallelic marker by any method known in the art. These methods find use in genotyping case-control populations in association studies as well as individuals in the context of detection of alleles of biallelic markers which, are known to be associated with a given trait, in which case both copies of the biallelic marker present in individual's genome are determined so that an individual may be classified as homozygous or heterozygous for a particular allele.

These genotyping methods can be performed nucleic acid samples derived from a single individual or pooled DNA samples.

Genotyping can be performed using similar methods as those described above for the identification of the biallelic markers, or using other genotyping methods such as those further described below. In preferred embodiments, the comparison of sequences of amplified genomic fragments from different individuals is used to identify new biallelic markers whereas microsequencing is used for genotyping known biallelic markers in diagnostic and association study applications.

III.A. Source of DNA for Genotyping

Any source of nucleic acids, in purified or non-purified form, can be utilized as the starting nucleic acid, provided it contains or is suspected of containing the specific nucleic acid sequence desired. DNA or RNA may be extracted from cells, tissues, body fluids and the like as described above in II.A. While nucleic acids for use in the genotyping methods of the invention can be derived from any mammalian source, the test subjects and individuals from which nucleic acid samples are taken are generally understood to be human.

III.B. Amplification Of DNA Fragments Comprising Biallelic Markers

Methods and polynucleotides are provided to amplify a segment of nucleotides comprising one or more biallelic marker of the present invention. It will be appreciated that amplification of DNA fragments comprising biallelic markers may be used in various methods and for various purposes and is not restricted to genotyping. Nevertheless, many genotyping methods, although not all, require the previous amplification of the DNA region carrying the biallelic marker of interest. Such methods specifically increase the concentration or total number of sequences that span the biallelic marker or include that site and sequences located either distal or proximal to it. Diagnostic assays may also rely on amplification of DNA segments carrying a biallelic marker of the present invention.

Amplification of DNA may be achieved by any method known in the art. The established PCR (polymerase chain reaction) method or by developments thereof or alternatives. Amplification methods which can be utilized herein include but are not limited to Ligase Chain Reaction (LCR) as described in EP A 320 308 and EP A 439 182, Gap LCR (Wolcott, M. J., Clin. Mcrobiol. Rev. 5:370–386), the so-called "NASBA" or "3SR" technique described in Guatelli J. C. et al. (*Proc. Natl. Acad. Sci. USA* 87:1874–1878, 1990) and in Compton J. (*Nature* 350:91–92, 1991), Q-beta amplification as described in European Patent Application no 4544610, strand displacement amplification as described in Walker et al. (*Clin. Chem.* 42:9–13, 1996) and EP A 684 315 and, target mediated amplification as described in PCT Publication WO 9322461, the disclosures of which are incorporated herein by reference in their entireties.

LCR and Gap LCR are exponential amplification techniques, both depend on DNA ligase to join adjacent primers annealed to a DNA molecule. In Ligase Chain Reaction (LCR), probe pairs are used which include two primary (first and second) and two secondary (third and fourth) probes, all of which are employed in molar excess to target. The first probe hybridizes to a first segment of the target strand and the second probe hybridizes to a second segment of the target strand, the first and second segments being contiguous so that the primary probes abut one another in 5' phosphate-3'hydroxyl relationship, and so that a ligase can covalently fuse or ligate the two probes into a fused product. In addition, a third (secondary) probe can hybridize to a portion of the first probe and a fourth (secondary) probe can hybridize to a portion of the second probe in a similar abutting fashion. Of course, if the target is initially double stranded, the secondary probes also will hybridize to the target complement in the first instance. Once the ligated strand of primary probes is separated from the target strand, it will hybridize with the third and fourth probes which can be ligated to form a complementary, secondary ligated product. It is important to realize that the ligated products are functionally equivalent to either the target or its complement. By repeated cycles of hybridization and ligation, amplification of the target sequence is achieved. A method for multiplex LCR has also been described (WO 9320227, the disclosure of which is incorporated herein by reference in its entirety). Gap LCR (GLCR) is a version of LCR where the probes are not adjacent but are separated by 2 to 3 bases.

For amplification of mRNAs, it is within the scope of the present invention to reverse transcribe mRNA into cDNA followed by polymerase chain reaction (RT-PCR); or, to use a single enzyme for both steps as described in U.S. Pat. No. 5,322,770, the disclosure of which is incorporated herein by reference in its entirety, or, to use Asymmetric Gap LCR (RT-AGLCR) as described by Marshall R. L. et al. (*PCR Methods and Applications* 4:80–84, 1994, the disclosure of which is incorporated herein by reference in its entirety). AGLCR is a modification of GLCR that allows the amplification of RNA.

Some of these amplification methods are particularly suited for the detection of single nucleotide polymorphisms and allow the simultaneous amplification of a target sequence and the identification of the polymorphic nucleotide as it is further described in III.C.

The PCR technology is the preferred amplification technique used in the present invention. A variety of PCR techniques are familiar to those skilled in the art. For a review of PCR technology, see Molecular Cloning to Genetic Engineering White, B.A. Ed. in *Methods in Molecular Biology* 67: Humana Press, Totowa (1997) and the publication entitled "PCR Methods and Applications" (1991, Cold Spring Harbor Laboratory Press, the disclosures of which are incorporated herein by reference in their entireties). In each of these PCR procedures, PCR primers on either side of the nucleic acid sequences to be amplified are added to a suitably prepared nucleic acid sample along with dNTPs and a thermostable polymerase such as Taq polymerase, Pfu polymerase, or Vent polymerase. The nucleic acid in the sample is denatured and the PCR primers are specifically hybridized to complementary nucleic acid sequences in the sample. The hybridized primers are extended. Thereafter, another cycle of denaturation, hybridization, and extension is initiated. The cycles are repeated multiple times to produce an amplified fragment containing the nucleic acid sequence between the primer sites. PCR has further been described in several patents including U.S. Pat. Nos. 4,683,195, 4,683,202 and 4,965,188, the disclosures of which are incorporated herein by reference in their entireties.

The identification of biallelic markers as described above allows the design of appropriate oligonucleotides, which can be used as primers to amplify DNA fragments comprising the biallelic markers of the present invention. Amplification can be performed using the primers initially used to discover new biallelic markers which are described herein or any set of primers allowing the amplification of a DNA fragment comprising a biallelic marker of the present invention. Primers can be prepared by any suitable method. As for example, direct chemical synthesis by a method such as the phosphodiester method of Narang S. A. et al. (*Methods Enzymol*. 68:90–98, 1979), the phosphodiester method of Brown E. L. et al. (*Methods Enzymol*. 68:109–151, 1979), the diethylphosphoramidite method of Beaucage et al. (*Tetrahedron Lett*. 22:1859–1862, 1981) and the solid support method described in EP 0 707 592, the disclosures of which are incorporated herein by reference in their entireties.

In some embodiments the present invention provides primers for amplifying a DNA fragment containing one or more biallelic markers of the present invention. Preferred amplification primers are listed in SEQ ID Nos. 3935 to 7842, 3935 to 6194, 6195 to 7668, 7669 to 7842, 7866 to 11773, 7866 to 10125, 10126 to 11599, and 11600 to 11773. It will be appreciated that the primers listed are merely exemplary and that any other set of primers which produce amplification products containing one or more biallelic markers of the present invention.

The primers are selected to be substantially complementary to the different strands of each specific sequence to be amplified. The length of the primers of the present invention can range from 8 to 100 nucleotides, preferably from 8 to 50, 8 to 30 or more preferably 8 to 25 nucleotides. Shorter primers tend to lack specificity for a target nucleic acid sequence and generally require cooler temperatures to form sufficiently stable hybrid complexes with the template. Longer primers are expensive to produce and can sometimes self-hybridize to form hairpin structures. The formation of stable hybrids depends on the melting temperature (Tm) of the DNA. The Tm depends on the length of the primer, the ionic strength of the solution and the G+C content. The higher the G+C content of the primer, the higher is the melting temperature because G:C pairs are held by three H bonds whereas A:T pairs have only two. The G+C content of the amplification primers of the present invention preferably ranges between 10 and 75%, more preferably between 35 and 60%, and most preferably between 40 and 55%. The appropriate length for primers under a particular set of assay conditions may be empirically determined by one of skill in the art.

The spacing of the primers determines the length of the segment to be amplified. In the context of the present invention amplified segments carrying biallelic markers can range in size from at least about 25 bp to 35 kbp. Amplification fragments from 25–3000 bp are typical, fragments from 50–1000 bp are preferred and fragments from 100–600 bp are highly preferred. It will be appreciated that amplification primers for the biallelic markers may be any sequence which allow the specific amplification of any DNA fragment carrying the markers. Amplification primers may be labeled or immobilized on a solid support as described in I.

III.C. Methods of Genotyping DNA Samples for Biallelic Markers

Any method known in the art can be used to identify the nucleotide present at a biallelic marker site. Since the biallelic marker allele to be detected has been identified and specified in the present invention, detection will prove simple for one of ordinary skill in the art by employing any of a number of techniques. Many genotyping methods require the previous amplification of the DNA region carrying the biallelic marker of interest. While the amplification of target or signal is often preferred at present, ultrasensitive detection methods which do not require amplification are also encompassed by the present genotyping methods. Methods well-known to those skilled in the art that can be used to detect biallelic polymorphisms include methods such as, conventional dot blot analyzes, single strand conformational polymorphism analysis (SSCP) described by Orita et al. (*Proc. Natl. Acad. Sci. U.S.A* 86:27776–2770, 1989, the disclosure of which is incorporated herein by reference in its entirety), denaturing gradient gel electrophoresis (DGGE), heteroduplex analysis, mismatch cleavage detection, and other conventional techniques as described in Sheffield, V. C. et al. (*Proc. Natl. Acad. Sci. USA* 49:699–706, 1991), White et al. (*Genomics* 12:301–306, 1992), Grompe, M. et al. (*Proc. Natl. Acad. Sci. USA* 86:5855–5892, 1989) and Grompe, M. (*Nature Genetics* 5:111–117, 1993, the disclosures of which are incorporated herein by reference in their entireties). Another method for determining the identity of the nucleotide present at a particular polymorphic site employs a specialized exonuclease-resistant nucleotide derivative as described in U.S. Pat. No. 4,656,127, the disclosure of which is incorporated herein by reference in its entirety.

Preferred methods involve directly determining the identity of the nucleotide present at a biallelic marker site by sequencing assay, enzyme-based mismatch detection assay, or hybridization assay. The following is a description of some preferred methods. A highly preferred method is the microsequencing technique. The term "sequencing assay" is used herein to refer to polymerase extension of duplex primer/template complexes and includes both traditional sequencing and microsequencing.

1) Sequencing Assays

The nucleotide present at a polymorphic site can be determined by sequencing methods. In a preferred embodiment, DNA samples are subjected to PCR amplification before sequencing as described above. DNA sequencing methods are described in IIC.

Preferably, the amplified DNA is subjected to automated dideoxy terminator sequencing reactions using a dye-primer cycle sequencing protocol. Sequence analysis allows the identification of the base present at the biallelic marker site.

2) Microsequencing Assays

In microsequencing methods, a nucleotide at the polymorphic site that is unique to one of the alleles in a target DNA is detected by a single nucleotide primer extension reaction. This method involves appropriate microsequencing primers which, hybridize just upstream of a polymorphic base of interest in the target nucleic acid. A polymerase is used to specifically extend the 3' end of the primer with one single ddNTP (chain terminator) complementary to the selected nucleotide at the polymorphic site. Next the identity of the incorporated nucleotide is determined in any suitable way.

Typically, microsequencing reactions are carried out using fluorescent ddNTPs and the extended microsequencing primers are analyzed by electrophoresis on ABI 377 sequencing machines to determine the identity of the incorporated nucleotide as described in EP 412 883, the disclosure of which is incorporated herein by reference in its entirety. Alternatively capillary electrophoresis can be used in order to process a higher number of assays simultaneously. An example of a typical microsequencing procedure that can be used in the context of the present invention is provided in Example 8.

Different approaches can be used to detect the nucleotide added to the microsequencing primer. A homogeneous phase detection method based on fluorescence resonance energy transfer has been described by Chen and Kwok (*Nucleic Acids Research* 25:347–353 1997) and Chen et al. (*Proc. Natl. Acad. Sci. USA* 94/20 10756–10761,1997, the disclosures of which are incorporated herein by reference in their entireties). In this method, amplified genomic DNA fragments containing polymorphic sites are incubated with a 5'-fluorescein-labeled primer in the presence of allelic dye-labeled dideoxyribonucleoside triphosphates and a modified Taq polymerase. The dye-labeled primer is extended one base by the dye-terminator specific for the allele present on the template. At the end of the genotyping reaction, the fluorescence intensities of the two dyes in the reaction mixture are analyzed directly without separation or purification. All of these steps can be performed in the same tube and the fluorescence changes can be monitored in real time. Alternatively, the extended primer may be analyzed by MALDI-TOF Mass Spectrometry. The base at the polymorphic site is identified by the mass added onto the microsequencing primer (see Haff L. A. and Smirnov I. P., *Genome Research*, 7:378–388, 1997, the disclosure of which is incorporated herein by reference in its entirety).

Microsequencing may be achieved by the established microsequencing method or by developments or derivatives thereof. Alternative methods include several solid-phase microsequencing techniques. The basic microsequencing protocol is the same as described previously, except that the method is conducted as a heterogenous phase assay, in which the primer or the target molecule is immobilized or captured onto a solid support. To simplify the primer separation and the terminal nucleotide addition analysis, oligonucleotides are attached to solid supports or are modified in such ways that permit affinity separation as well as polymerase extension. The 5' ends and internal nucleotides of synthetic oligonucleotides can be modified in a number of different ways to permit different affinity separation approaches, e.g., biotinylation. If a single affinity group is used on the oligonucleotides, the oligonucleotides can be separated from the incorporated terminator regent. This eliminates the need of physical or size separation. More than one oligonucleotide can be separated from the terminator reagent and analyzed simultaneously if more than one affinity group is used. This permits the analysis of several nucleic acid species or more nucleic acid sequence information per extension reaction. The affinity group need not be on the priming oligonucleotide but could alternatively be present on the template. For example, immobilization can be carried out via an interaction between biotinylated DNA and streptavidin-coated microtitration wells or avidin-coated polystyrene particles. In the same manner oligonucleotides or templates may be attached to a solid support in a high-density format. In such solid phase microsequencing reactions, incorporated ddNTPs can be radiolabeled (Syvänen, *Clinica Chimica Acta* 226:225–236, 1994, the disclosure of which is incorporated herein by reference in its entirety), or linked to fluorescein (Livak and Hainer, *Human Mutation* 3:379–385,1994, the disclosure of which is incorporated herein by reference in its entirety). The detection of radiolabeled ddNTPs can be achieved through scintillation-based techniques. The detection of fluorescein-linked ddNTT's can be based on the binding of antifluorescein antibody conjugated with alkaline phosphatase, followed by incubation with a chromogenic substrate (such asp-nitrophenyl phosphate). Other possible reporter-detection pairs include: ddNTP linked to dinitrophenyl (DNP) and anti-DNP alkaline phosphatase conjugate (Harju et al., *Clin. Chem.* 39/11 2282–2287, 1993, the disclosure of which is incorporated herein by reference in its entirety), or biotinylated ddNTP and horseradish peroxidase-conjugated streptavidin with o-phenylenediamine as a substrate (WO 92/15712, the disclosure of which is incorporated herein by reference in its entirety). As yet another alternative solid-phase microsequencing procedure, Nyren et al. (*Analytical Biochemistry* 208:171–175, 1993, the disclosure of which is incorporated herein by reference in its entirety), described a method relying on the detection of DNA polymerase activity by an enzymatic luminometric inorganic pyrophosphate detection assay (ELIDA).

Pastinen et al. (*Genome Research* 7:606–614, 1997, the disclosure of which is incorporated herein by reference in its entirety), describe a method for multiplex detection of single nucleotide polymorphism in which the solid phase minisequencing principle is applied to an oligonucleotide array format. High-density arrays of DNA probes attached to a solid support (DNA chips) are further described in III.C.5.

In one aspect, the present invention provides polynucleotides and methods to genotype one or more biallelic markers of the present invention by performing a microsequencing assay. In the preferred embodiment, it will be appreciated that any primer having a 3' end immediately adjacent to a polymorphic nucleotide may be used as a microsequencing primer. Similarly, it will be appreciated that microsequencing analysis may be performed for any biallelic marker or any combination of biallelic markers of the present invention. One aspect of the present invention is a solid support which includes one or more microsequencing primers comprising nucleotides complementary to the nucleotide sequences of SEQ ID Nos. 1 to 3908, 1 to 2260, 2261 to 3374, and 3735 to 3908 or the complements thereof, or fragments comprising at least 8, at least 12, at least 15, or at least 20 consecutive nucleotides thereof and having a 3' terminus immediately upstream of the corresponding biallelic marker, for determining the identity of a nucleotide at biallelic marker site.

3) Mismatch Detection Assays Based on Polymerases and Ligases

In one aspect the present invention provides polynucleotides and methods to determine the allele of one or more biallelic markers of the present invention in a biological sample, by mismatch detection assays based on polymerases and/or ligases. These assays are based on the specificity of polymerases and ligases. Polymerization reactions places particularly stringent requirements on correct base pairing of the 3' end of the amplification primer and the joining of two oligonucleotides hybridized to a target DNA sequence is quite sensitive to mismatches close to the ligation site, especially at the 3' end. The terms "enzyme based mismatch detection assay" are used herein to refer to any method of determining the allele of a biallelic marker based on the specificity of ligases and polymerases. Preferred methods are described below. Methods, primers and various parameters to amplify DNA fragments comprising biallelic markers of the present invention are further described above in III.B.

Allele Specific Amplification

Discrimination between the two alleles of a biallelic marker can also be achieved by allele specific amplification, a selective strategy, whereby one of the alleles is amplified without amplification of the other allele. This is accomplished by placing a polymorphic base at the 3' end of one of the amplification primers. Because the extension forms from the 3' end of the primer, a mismatch at or near this position has an inhibitory effect on amplification. Therefore, under appropriate amplification conditions, these primers only direct amplification on their complementary allele. Designing the appropriate allele-specific primer and the corresponding assay conditions are well with the ordinary skill in the art.

Ligation/Amplification Based Methods

The "Oligonucleotide Ligation Assay" (OLA) uses two oligonucleotides which are designed to be capable of hybridizing to abutting sequences of a single strand of a target molecules. One of the oligonucleotides is biotinylated, and the other is detectably labeled. If the precise complementary sequence is found in a target molecule, the oligonucleotides will hybridize such that their termini abut, and create a ligation substrate that can be captured and detected. OLA is capable of detecting biallelic markers and may be advantageously combined with PCR as described by Nickerson D. A. et al. (*Proc. Natl. Acad. Sci. U.S.A.* 87:8923–8927, 1990, the disclosure of which is incorporated herein by reference in its entirety). In this method, PCR is used to achieve the exponential amplification of target DNA, which is then detected using OLA.

Other methods which are particularly suited for the detection of biallelic markers include LCR (ligase chain reaction), Gap LCR (GLCR) which are described above in III.B. As mentioned above LCR uses two pairs of probes to exponentially amplify a specific target. The sequences of each pair of oligonucleotides, is selected to permit the pair to hybridize to abutting sequences of the same strand of the target. Such hybridization forms a substrate for a template-dependant ligase. In accordance with the present invention, LCR can be performed with oligonucleotides having the proximal and distal sequences of the same strand of a biallelic marker site. In one embodiment, either oligonucleotide will be designed to include the biallelic marker site. In such an embodiment, the reaction conditions are selected such that the oligonucleotides can be ligated together only if the target molecule either contains or lacks the specific nucleotide(s) that is complementary to the biallelic marker on the oligonucleotide. In an alternative embodiment, the oligonucleotides will not include the biallelic marker, such that when they hybridize to the target molecule, a "gap" is created as described in WO 90/01069, the disclosure of which is incorporated herein by reference in its entirety. This gap is then "filled" with complementary dNTPs (as mediated by DNA polymerase), or by an additional pair of oligonucleotides. Thus at the end of each cycle, each single strand has a complement capable of serving as a target during the next cycle and exponential allele-specific amplification of the desired sequence is obtained.

Ligase/Polymerase-mediated Genetic Bit Analysis™ is another method for determining the identity of a nucleotide at a preselected site in a nucleic acid molecule (WO 95/21271, the disclosure of which is incorporated herein by reference in its entirety). This method involves the incorporation of a nucleoside triphosphate that is complementary to the nucleotide present at the preselected site onto the terminus of a primer molecule, and their subsequent ligation to a second oligonucleotide. The reaction is monitored by detecting a specific label attached to the reaction's solid phase or by detection in solution.

4) Hybridization Assay Methods

A preferred method of determining the identity of the nucleotide present at a biallelic marker site involves nucleic acid hybridization. The hybridization probes, which can be conveniently used in such reactions, preferably include the probes defined herein. Any hybridization assay may be used including Southern hybridization, Northern hybridization, dot blot hybridization and solid-phase hybridization (see Sambrook et al., Molecular Cloning—A Laboratory Manual, Second Edition, Cold Spring Harbor Press, N.Y., 1989, the disclosure of which is incorporated herein by reference in its entirety).

Hybridization refers to the formation of a duplex structure by two single stranded nucleic acids due to complementary base pairing. Hybridization can occur between exactly complementary nucleic acid strands or between nucleic acid strands that contain minor regions of mismatch. Specific probes can be designed that hybridize to one form of a biallelic marker and not to the other and therefore are able to discriminate between different allelic forms. Allele-specific probes are often used in pairs, one member of a pair showing perfect match to a target sequence containing the original allele and the other showing a perfect match to the target sequence containing the alternative allele. Hybridization conditions should be sufficiently stringent that there is a significant difference in hybridization intensity between alleles, and preferably an essentially binary response, whereby a probe hybridizes to only one of the alleles. Stringent, sequence specific hybridization conditions, under which a probe will hybridize only to the exactly complementary target sequence are well known in the art (Sambrook et al., Molecular Cloning—A Laboratory Manual, Second Edition, Cold Spring Harbor Press, N.Y., 1989, the disclosure of which is incorporated herein by reference in its entirety). Stringent conditions are sequence dependent and will be different in different circumstances. Generally, stringent conditions are selected to be about 5° C. lower than the thermal melting point (Tm) for the specific sequence at a defined ionic strength and pH. By way of example and not limitation, procedures using conditions of high stringency are as follows: Prehybridization of filters containing DNA is carried out for 8 h to overnight at 65° C. in buffer composed of 6×SSC, 50 mM Tris-HCl (pH 7.5), 1 mM EDTA, 0.02% PVP, 0.02% Ficoll, 0.02% BSA, and 500 µg/ml denatured salmon sperm DNA. Filters are hybridized for 48 h at 65° C., the preferred hybridization temperature, in prehybridization mixture containing 100 µg/ml denatured salmon sperm DNA and 5–20×10$^6$ cpm of $^{32}$P-labeled probe. Alternatively, the hybridization step can be performed at 65° C. in the presence of SSC buffer, 1×SSC corresponding to 0.15M NaCl and 0.05 M Na citrate. Subsequently, filter washes can be done at 37° C. for 1 h in a solution containing 2×SSC, 0.01% PVP, 0.01% Ficoll, and 0.01% BSA, followed by a wash in 0.1×SSC at 50° C. for 45 min. Alternatively, filter washes can be performed in a solution containing 2×SSC and 0.1% SDS, or 0.5×SSC and 0.1% SDS, or 0.1×SSC and 0.1% SDS at 68° C. for 15 minute intervals. Following the wash steps, the hybridized probes are detectable by autoradiography. By way of example and not limitation, procedures using conditions of intermediate stringency are as follows: Filters containing DNA are prehybridized, and then hybridized at a temperature of 60° C. in the presence of a 5×SSC buffer and labeled probe. Subsequently, filters washes are performed in a solution containing 2×SSC at 50° C. and the hybridized probes are detectable by autoradiography. Other conditions of high and intermediate stringency which may be used are well known in the art and as cited in Sambrook et al. (Molecular Cloning—A Laboratory Manual, Second Edition, Cold Spring Harbor Press, N.Y., 1989) and Ausubel et al. (Current Protocols in Molecular Biology, Green Publishing Associates and Wiley Interscience, N.Y., 1989, the disclosure of which is incorporated herein by reference in its entirety).

Although such hybridizations can be performed in solution, it is preferred to employ a solid-phase hybridization assay. The target DNA comprising a biallelic marker of the present invention may be amplified prior to the hybridization reaction. The presence of a specific allele in the sample is determined by detecting the presence or the absence of stable hybrid duplexes formed between the probe and the target DNA. The detection of hybrid duplexes can be carried out by a number of methods. Various detection assay formats are well known which utilize detectable labels bound to either the target or the probe to enable detection of the hybrid duplexes. Typically, hybridization duplexes are separated from unhybridized nucleic acids and the labels bound to the duplexes are then detected. Those skilled in the art will recognize that wash steps may be employed to wash away excess target DNA or probe. Standard heterogeneous assay formats are suitable for detecting the hybrids using the labels present on the primers and probes.

Two recently developed assays allow hybridization-based allele discrimination with no need for separations or washes (see Landegren U. et al., *Genome Research*, 8:769–776, 1998, the disclosure of which is incorporated herein by reference in its entirety). The TaqMan assay takes advantage of the 5' nuclease activity of Taq DNA polymerase to digest a DNA probe annealed specifically to the accumulating amplification product. TaqMan probes are labeled with a donor-acceptor dye pair that interacts via fluorescence energy transfer. Cleavage of the TaqMan probe by the advancing polymerase during amplification dissociates the donor dye from the quenching acceptor dye, greatly increasing the donor fluorescence. All reagents necessary to detect two allelic variants can be assembled at the beginning of the reaction and the results are monitored in real time (see Livak et al., *Nature Genetics*, 9:341–342, 1995, the disclosure of which is incorporated herein by reference in its entirety). In an alternative homogeneous hybridization-based procedure, molecular beacons are used for allele discriminations. Molecular beacons are hairpin-shaped oligonucleotide probes that report the presence of specific nucleic acids in homogeneous solutions. When they bind to their targets, they undergo a conformational reorganization that restores the fluorescence of an internally quenched fluorophore (Tyagi et al., *Nature Biotechnology*, 16:49–53, 1998, the disclosure of which is incorporated herein by reference in its entirety).

The polynucleotides provided herein can be used in hybridization assays for the detection of biallelic marker alleles in biological samples. These probes are characterized in that they preferably comprise between 8 and 50 nucleotides, and in that they are sufficiently complementary to a sequence comprising a biallelic marker of the present invention to hybridize thereto and preferably sufficiently specific to be able to discriminate the targeted sequence for only one nucleotide variation. The GC content in the probes of the invention usually ranges between 10 and 75%, preferably between 35 and 60%, and more preferably between 40 and 55%. The length of these probes can range from 10, 15, 20, or 30 to at least 100 nucleotides, preferably from 10 to 50, more preferably from 18 to 35 nucleotides. A particularly preferred probe is 25 nucleotides in length. Preferably the biallelic marker is within 4 nucleotides of the center of the polynucleotide probe. In particularly preferred probes the biallelic marker is at the center of said polynucleotide. Shorter probes may lack specificity for a target nucleic acid sequence and generally require cooler temperatures to form sufficiently stable hybrid complexes with the template. Longer probes are expensive to produce and can sometimes self-hybridize to form hairpin structures. Methods for the synthesis of oligonucleotide probes have been described above and can be applied to the probes of the present invention.

Preferably, the probes of the-present invention are labeled or immobilized on a solid support. Labels and solid supports are further described in I. Detection probes are generally nucleic acid sequences or uncharged nucleic acid analogs such as, for example peptide nucleic acids which are disclosed in International Patent Application WO 92/20702, the disclosure of which is hereby incorporated herein by reference in its entirety, and morpholino analogs which are described in U.S. Pat. Nos. 5,185,444; 5,034,506 and 5,142,047, the disclosures of which are hereby incorporated herein by reference in their entireties. The probe may have to be rendered "non-extendable" in that additional dNTPs cannot be added to the probe. In and of themselves analogs usually are non-extendable and nucleic acid probes can be rendered non-extendable by modifying the 3' end of the probe such that the hydroxyl group is no longer capable of participating in elongation. For example, the 3' end of the probe can be finctionalized with the capture or detection label to thereby consume or otherwise block the hydroxyl group. Alternatively, the 3' hydroxyl group simply can be cleaved, replaced or modified, U.S. patent application Ser. No. 07/049,061 filed Apr. 19, 1993 describes modifications, which can be used to render a probe non-extendable.

The probes of the present invention are useful for a number of purposes. They can be used in Southern hybridization to genomic DNA or Northern hybridization to mRNA. The probes can also be used to detect PCR amplification products. By assaying the hybridization to an allele specific probe, one can detect the presence or absence of a biallelic marker allele in a given sample.

High-throughput parallel hybridizations in array format are specifically encompassed within "hybridization assays" and are described below.

Hybridization to Addressable Arrays of Oligonucleotides

Hybridization assays based on oligonucleotide arrays rely on the differences in hybridization stability of short oligonucleotides to perfectly matched and mismatched target sequence variants. Efficient access to polymorphism information is obtained through a basic structure comprising high-density arrays of oligonucleotide probes attached to a solid support (the chip) at selected positions. Each DNA chip can contain thousands to millions of individual synthetic DNA probes arranged in a grid-like pattern and miniaturized to the size of a dime.

The chip technology has already been applied with success in numerous cases. For example, the screening of mutations has been undertaken in the BRCA1 gene, in *S. cerevisiae* mutant strains, and in the protease gene of HIV-1 virus (Hacia et al., *Nature Genetics*, 14(4):441–447, 1996; Shoemaker et al., *Nature Genetics*, 14(4):450–456, 1996; Kozal et al., *Nature Medicine*, 2:753–759, 1996, the disclosures of which are incorporated herein by reference in their entireties). Chips of various formats for use in detecting biallelic polymorphisms can be produced on a customized basis by Affymetrix (GeneChip™), Hyseq (HyChip and HyGnostics), and Protogene Laboratories.

In general, these methods employ arrays of oligonucleotide probes that are complementary to target nucleic acid sequence segments from an individual which, target sequences include a polymorphic marker. EP785280, the disclosure of which is incorporated herein by reference in its entirety, describes a tiling strategy for the detection of single nucleotide polymorphisms. Briefly, arrays may generally be "tiled" for a large number of specific polymorphisms. By "tiling" is generally meant the synthesis of a defined set of oligonucleotide probes which is made up of a sequence complementary to the target sequence of interest, as well as preselected variations of that sequence, e.g., substitution of one or more given positions with one or more members of the basis set of monomers, i.e. nucleotides. Tiling strategies are further described in PCT application No. WO 95/11995, the disclosure of which is incorporated herein by reference in its entirety. In a particular aspect, arrays are tiled for a number of specific, identified biallelic marker sequences. In particular the array is tiled to include a number of detection blocks, each detection block being specific for a specific biallelic marker or a set of biallelic markers. For example, a detection block may be tiled to include a number of probes, which span the sequence segment that includes a specific polymorphism. To ensure probes that are complementary to each allele, the probes are synthesized in pairs differing at the biallelic marker. In addition to the probes differing at the polymorphic base, monosubstituted probes are also generally tiled within the detection block. These monosubstituted probes have bases at and up to a certain number of bases in either direction from the polymorphism, substituted with the remaining nucleotides (selected from A, T, G, C and U). Typically the probes in a tiled detection block will include substitutions of the sequence positions up to and including those that are 5 bases away from the biallelic marker. The monosubstituted probes provide internal controls for the tiled array, to distinguish actual hybridization from artefactual cross-hybridization. Upon completion of hybridization with the target sequence and washing of the array, the array is scanned to determine the position on the array to which the target sequence hybridizes. The hybridization data from the scanned array is then analyzed to identify which allele or alleles of the biallelic marker are present in the sample. Hybridization and scanning may be carried out as described in PCT application No. WO 92/10092 and WO 95/11995 and U.S. Pat. No. 5,424,186, the disclosures of which are incorporated herein by reference in their entireties.

Thus, in some embodiments, the chips may comprise an array of nucleic acid sequences of fragments of about 15 nucleotides in length. In further embodiments, the chip may comprise an array including at least one of the sequences selected from the group consisting of SEQ ID No. 1 to 3908, 1 to 2260, 2261 to 3374, and 3735 to 3908 and the sequences complementary thereto, or a fragment thereof at least about 8 consecutive nucleotides, preferably 10, 15, 20, more preferably least 30, 35, 43, 44, 45, 46 or 47 consecutive nucleotides, to the extent that a contiguous span of these lengths is consistent with the lengths of the particular Sequence ID. In some embodiments, the chip may comprise an array of at least 2, 3, 4, 5, 6, 7, 8 or more of these polynucleotides of the invention. Solid supports and polynucleotides of the present invention attached to solid supports are further described in I.

5) Integrated Systems

Another technique, which may be used to analyze polymorphisms, includes multicomponent integrated systems, which miniaturize and compartmentalize processes such as PCR and capillary electrophoresis reactions in a single functional device. An example of such technique is disclosed in U.S. Pat. No. 5,589,136, the disclosure of which is hereby incorporated herein by reference in its entirety, which describes the integration of PCR amplification and capillary electrophoresis in chips.

Integrated systems can be envisaged mainly when microfluidic systems are used. These systems comprise a pattern of microchannels designed onto a glass, silicon, quartz, or plastic wafer included on a microchip. The movements of the samples are controlled by electric, electroosmotic or hydrostatic forces applied across different areas of the microchip. For genotyping biallelic markers, the microfluidic system may integrate nucleic acid amplification, microsequencing, capillary electrophoresis and a detection method such as laser-induced fluorescence detection.

IV. Methods Of Genetic Analysis Using The Biallelic Markers Of The Present Invention Different methods are available for the genetic analysis of complex traits (see Lander and Schork, *Science*, 265, 2037–2048, 1994, the disclosure of which is hereby incorporated herein by reference in its entirety). The search for disease-susceptibility genes is conducted using two main methods: the linkage approach in which evidence is sought for cosegregation between a locus and a putative trait locus using family studies, and the association approach in which evidence is sought for a statistically significant association between an allele and a trait or a trait causing allele (Khoury J. et al., *Fundamentals of Genetic Epidemiology*, Oxford University Press, New York, 1993, the disclosure of which is incorporated herein by reference in its entirety). In general, the biallelic markers of the present invention find use in any method known in the art to demonstrate a statistically significant correlation between a genotype and a phenotype. The biallelic markers may be used in parametric and non-parametric linkage analysis methods. Preferably, the biallelic markers of the present invention are used to identify genes associated with detectable traits using association studies, an approach which does not require the use of affected families and which permits the identification of genes associated with complex and sporadic traits.

The genetic analysis using the biallelic markers of the present invention may be conducted on any scale. The whole set of biallelic markers of the present invention or any subset of biallelic markers of the present invention may be used. In some embodiments a subset of biallelic markers corresponding to one or several candidate genes may be used. In other embodiments a subset of biallelic markers corresponding to candidate genes from a particular disease pathway may be used. Alternatively, a subset of biallelic markers of the present invention localised on a specific chromosome segment may be used. Further, any set of genetic markers including a biallelic marker of the present invention may be used. A set of biallelic polymorphisms that, could be used as genetic markers in combination with the biallelic markers of the present invention, has been described in WO 98/20165, the disclosure of which is incorporated herein by reference in its entirety. As mentioned above, it should be noted that the biallelic markers of the present invention may be included in any complete or partial genetic map of the

IV.A. Linkage Analysis

Linkage analysis is based upon establishing a correlation between the transmission of genetic markers and that of a specific trait throughout generations within a family. Thus, the aim of linkage analysis is to detect marker loci that show cosegregation with a trait of interest in pedigrees.

Parametric Methods

When data are available from successive generations there is the opportunity to study the degree of linkage between pairs of loci. Estimates of the recombination fraction enable loci to be ordered and placed onto a genetic map. With loci that are genetic markers, a genetic map can be established, and then the strength of linkage between markers and traits can be calculated and used to indicate the relative positions of markers and genes affecting those traits (Weir, B. S., *Genetic data Analysis II: Methods for Discrete population genetic Data*, Sinauer Assoc., Inc., Sunderland, Mass., USA, 1996, the disclosure of which is incorporated herein by reference in its entirety). The classical method for linkage analysis is the logarithm of odds (lod) score method (see Morton N. E., *Am. J. Hum. Genet.*, 7:277–318, 1955; Ott J., *Analysis of Human Genetic Linkage*, John Hopkins University Press, Baltimore, 1991, the disclosures of which are incorporated herein by reference in their entireties). Calculation of lod scores requires specification of the mode of inheritance for the disease (parametric method). Generally, the length of the candidate region identified using linkage analysis is between 2 and 20 Mb. Once a candidate region is identified as described above, analysis of recombinant individuals using additional markers allows further delineation of the candidate region. Linkage analysis studies have generally relied on the use of a maximum of 5,000 microsatellite markers, thus limiting the maximum theoretical attainable resolution of linkage analysis to about 600 kb on average.

Linkage analysis has been successfully applied to map simple genetic traits that show clear Mendelian inheritance patterns and which have a high penetrance (i.e., the ratio between the number of trait positive carriers of allele a and the total number of a carriers in the population). However, parametric linkage analysis suffers from a variety of drawbacks. First, it is limited by its reliance on the choice of a genetic model suitable for each studied trait. Furthermore, as already mentioned, the resolution attainable using linkage analysis is limited, and complementary studies are required to refine the analysis of the typical 2 Mb to 20 Mb regions initially identified through linkage analysis. In addition, parametric linkage analysis approaches have proven difficult when applied to complex genetic traits, such as those due to the combined action of multiple genes and/or environmental factors. It is very difficult to model these factors adequately in a lod score analysis. In such cases, too large an effort and cost are needed to recruit the adequate number of affected families required for applying linkage analysis to these situations, as recently discussed by Risch, N. and Merikangas, K. (*Science*, 273:1516–1517, 1996, the disclosure of which is incorporated herein by reference in its entirety).

Non-parametric Methods

The advantage of the so-called non-parametric methods for linkage analysis is that they do not require specification of the mode of inheritance for the disease, they tend to be more useful for the analysis of complex traits. In non-parametric methods, one tries to prove that the inheritance pattern of a chromosomal region is not consistent with random Mendelian segregation by showing that affected relatives inherit identical copies of the region more often than expected by chance. Affected relatives should show excess "allele sharing" even in the presence of incomplete penetrance and polygenic inheritance. In non-parametric linkage analysis the degree of agreement at a marker locus in two individuals can be measured either by the number of alleles identical by state (IBS) or by the number of alleles identical by descent (IBD). Affected sib pair analysis is a well-known special case and is the simplest form of these methods.

The biallelic markers of the present invention may be used in both parametric and non-parametric linkage analysis. Preferably biallelic markers may be used in non-parametric methods which allow the mapping of genes involved in complex traits. The biallelic markers of the present invention may be used in both IBD- and IBS-methods to map genes affecting a complex trait. In such studies, taking advantage of the high density of biallelic markers, several adjacent biallelic marker loci may be pooled to achieve the efficiency attained by multi-allelic markers (Zhao et al., *Am. J. Hum. Genet.*, 63:225–240, 1998, the disclosure of which is incorporated herein by reference in its entirety).

However, both parametric and non-parametric linkage analysis methods analyse affected relatives, they tend to be of limited value in the genetic analysis of drug responses or in the analysis of side effects to treatments. This type of analysis is impractical in such cases due to the lack of availability of familial cases. In fact, the likelihood of having more than one individual in a family being exposed to the same drug at the same time is extremely low.

IV.B. Population Association Studies

The present invention comprises methods for identifying one or several genes among a set of candidate genes that are associated with a detectable trait using the biallelic markers of the present invention. In one embodiment the present invention comprises methods to detect an association between a biallelic marker allele or a biallelic marker haplotype and a trait. Further, the invention comprises methods to identify a trait causing allele in linkage disequilibrium with any biallelic marker allele of the present invention.

As described above, alternative approaches can be employed to perform association studies: genome-wide association studies, candidate region association studies and candidate gene association studies. In a preferred embodiment, the biallelic markers of the present invention are used to perform candidate gene association studies. Further, the biallelic markers of the present invention may be incorporated in any map of genetic markers of the human genome in order to perform genome-wide association studies. Methods to generate a high-density map of biallelic markers has been described in US Provisional Patent application serial No. 60/082,614. The biallelic markers of the present invention may further be incorporated in any map of a specific candidate region of the genome (a specific chromosome or a specific chromosomal segment for example).

As mentioned above, association studies may be conducted within the general population and are not limited to studies performed on related individuals in affected families. Association studies are extremely valuable as they permit the analysis of sporadic or multifactor traits. Moreover, association studies represent a powerful method for fine-scale mapping enabling much finer mapping of trait causing alleles than linkage studies. Studies based on pedigrees often only narrow the location of the trait causing allele. Association studies using the biallelic markers of the present invention can therefore be used to refine the location of a trait causing allele in a candidate region identified by Linkage Analysis methods. Moreover, once a chromosome segment of interest has been identified, the presence of a candidate gene such as a candidate gene of the present invention, in the region of interest can provide a shortcut to the identification of the trait causing allele. Biallelic markers of the present invention can be used to demonstrate that a candidate gene is associated with a trait. Such uses are specifically contemplated in the present invention and claims.

1) Determining the Frequency of a Biallelic Marker Allele or of a Biallelic Marker Haplotype in a Population Association studies explore the relationships among frequencies for sets of alleles between loci.

Determining the Frequency of an Allele in a Population

Allelic frequencies of the biallelic markers in a population can be determined using one of the methods described above under the heading "Methods for genotyping an individual for biallelic markers", or any genotyping procedure suitable for this intended purpose. Genotyping pooled samples or individual samples can determine the frequency of a biallelic marker allele in a population. One way to reduce the number of genotypings required is to use pooled samples. A major obstacle in using pooled samples is in terms of accuracy and reproducibility for determining accurate DNA concentrations in setting up the pools. Genotyping individual samples provides higher sensitivity, reproducibility and accuracy and; is the preferred method used in the present invention. Preferably, each individual is genotyped separately and simple gene counting is applied to determine the frequency of an allele of a biallelic marker or of a genotype in a given population.

Determining the Frequency of a Haplotype in a Population

The gametic phase of haplotypes is unknown when diploid individuals are heterozygous at more than one locus. Using genealogical information in families gametic phase can sometimes be inferred (Perlin et al., *Am. J. Hum. Genet.*, 55:777–787, 1994, the disclosure of which is incorporated herein by reference in its entirety). When no genealogical information is available different strategies may be used. One possibility is that the multiple-site heterozygous diploids can be eliminated from the analysis, keeping only the homozygotes and the single-site heterozygote individuals, but this approach might lead to a possible bias in the sample composition and the underestimation of low-frequency haplotypes. Another possibility is that single chromosomes can be studied independently, for example, by asymmetric PCR amplification (see Newton et al., *Nucleic Acids Res.*, 17:2503–2516, 1989; Wu et al., *Proc. Natl. Acad. Sci. USA*, 86:2757, 1989, the disclosures of which are incorporated herein by reference in their entireties) or by isolation of single chromosome by limit dilution followed by PCR amplification (see Ruano et al., *Proc. Natl. Acad. Sci. USA*, 87:6296–6300, 1990, the disclosure of which is incorporated herein by reference in its entirety). Further, a sample may be haplotyped for sufficiently close biallelic markers by double PCR amplification of specific alleles (Sarkar, G. and Sommer S. S., *Biotechniques*, 1991, the disclosure of which is incorporated herein by reference in its entirety). These approaches are not entirely satisfying either because of their technical complexity, the additional cost they entail, their lack of generalisation at a large scale, or the possible biases they introduce. To overcome these difficulties, an algorithm to infer the phase of PCR-amplified DNA genotypes introduced by Clark A. G. (*Mol. Biol. Evol*, 7:111–122, 1990, the disclosure of which is incorporated herein by reference in its entirety) may be used. Briefly, the principle is to start filling a preliminary list of haplotypes present in the sample by examining unambiguous individuals, that is, the complete homozygotes and the single-site heterozygotes. Then other individuals in the same sample are screened for the possible occurrence of previously recognised haplotypes. For each positive identification, the complementary haplotype is added to the list of recognised haplotypes, until the phase information for all individuals is either resolved or identified as unresolved. This method assigns a single haplotype to each multiheterozygous individual, whereas several haplotypes are possible when there are more than one heterozygous site. Alternatively, one can use methods estimating haplotype frequencies in a population without assigning haplotypes to each individual. Preferably, a method based on an expectation-maximization (EM) algorithm (Dempster et al., *J. R. Stat. Soc.*, 39B: 1–38, 1977, the disclosure of which is incorporated herein by reference in its entirety) leading to maximum-likelihood estimates of haplotype frequencies under the assumption of Hardy-Weinberg proportions (random mating) is used (see Excoffier L. and Slatkin M., *Mol. Biol. Evol.*, 12(5): 921–927, 1995, the disclosure of which is incorporated herein by reference in its entirety). The EM algorithm is a generalised iterative maximum-likelihood approach to estimation that is useful when data are ambiguous and/or incomplete. The EM algorithm is used to resolve heterozygotes into haplotypes. Haplotype estimations are further described below under the heading "Statistical methods". Any other method known in the art to determine or to estimate the frequency of a haplotype in a population may also be used.

2) Linkage Disequilibrium Analysis

Linkage disequilibrium is the non-random association of alleles at two or more loci and represents a powerful tool for mapping genes involved in disease traits (see Ajioka R. S. et al., *Am. J. Hum. Genet.*, 60:1439–1447, 1997, the disclosure of which is incorporated herein by reference in its entirety). Biallelic markers, because they are densely spaced in the human genome and can be genotyped in more numerous numbers than other types of genetic markers (such as RFLP or VNTR markers), are particularly useful in genetic analysis based on linkage disequilibrium. The biallelic markers of the present invention may be used in any linkage disequilibrium analysis method known in the art.

Briefly, when a disease mutation is first introduced into a population (by a new mutation or the immigration of a mutation carrier), it necessarily resides on a single chromosome and thus on a single "background" or "ancestral" haplotype of linked markers. Consequently, there is complete disequilibrium between these markers and the disease mutation: one finds the disease mutation only in the presence of a specific set of marker alleles. Through subsequent generations recombinations occur between the disease mutation and these marker polymorphisms, and the disequilibrium gradually dissipates. The pace of this dissipation is a function of the recombination frequency, so the markers closest to the disease gene will manifest higher levels of disequilibrium than those that are further away. When not broken up by recombination, "ancestral" haplotypes and linkage disequilibrium between marker alleles at different loci can be tracked not only through pedigrees but also through populations. Linkage disequilibrium is usually seen as an association between one specific allele at one locus and another specific allele at a second locus.

The pattern or curve of disequilibrium between disease and marker loci is expected to exhibit a maximum that occurs at the disease locus. Consequently, the amount of linkage disequilibrium between a disease allele and closely linked genetic markers may yield valuable information regarding the location of the disease gene. For fine-scale mapping of a disease locus, it is useful to have some knowledge of the patterns of linkage disequilibrium that exist between markers in the studied region. As mentioned above the mapping resolution achieved through the analysis of linkage disequilibrium is much higher than that of linkage studies. The high density of biallelic markers combined with linkage disequilibrium analysis provides powerful tools for fine-scale mapping. Different methods to calculate linkage disequilibrium are described below under the heading "Statistical Methods".

3) Population-based Case-control Studies of Trait-marker Associations

As mentioned above, the occurrence of pairs of specific alleles at different loci on the same chromosome is not random and the deviation from random is called linkage disequilibrium. Association studies focus on population frequencies and rely on the phenomenon of linkage disequilibrium. If a specific allele in a given gene is directly involved in causing a particular trait, its frequency will be statistically increased in an affected (trait positive) population, when compared to the frequency in a trait negative population or in a random control population. As a consequence of the existence of linkage disequilibrium, the frequency of all other alleles present in the haplotype carrying the trait-causing allele will also be increased in trait positive individuals compared to trait negative individuals or random controls. Therefore, association between the trait and any allele (specifically a biallelic marker allele) in linkage disequilibrium with the trait-causing allele will suffice to suggest the presence of a trait-related gene in that particular region. Case-control populations can be genotyped for biallelic markers to identify associations that narrowly locate a trait causing allele. As any marker in linkage disequilibrium with one given marker associated with a trait will be associated with the trait. Linkage disequilibrium allows the relative frequencies in case-control populations of a limited number of genetic polymorphisms (specifically biallelic markers) to be analysed as an alternative to screening all possible functional polymorphisms in order to find trait-causing alleles. Association studies compare the frequency of marker alleles in unrelated case-control populations, and represent powerful tools for the dissection of complex traits.

Case-control Populations (Inclusion Criteria)

Population-based association studies do not concern familial inheritance but compare the prevalence of a particular genetic marker, or a set of markers, in case-control populations. They are case-control studies based on comparison of unrelated case (affected or trait positive) individuals and unrelated control (unaffected or trait negative or random) individuals. Preferably the control group is composed of unaffected or trait negative individuals. Further, the control group is ethnically matched to the case population. Moreover, the control group is preferably matched to the case-population for the main known confusion factor for the trait under study (for example age-matched for an age-dependent trait). Ideally, individuals in the two samples are paired in such a way that they are expected to differ only in their disease status. In the following "trait positive population", "case population" and "affected population" are used interchangeably.

An important step in the dissection of complex traits using association studies is the choice of case-control populations (see Lander and Schork, *Science*, 265, 2037–2048, 1994, the disclosure of which is incorporated herein by reference in its entirety). A major step in the choice of case-control populations is the clinical definition of a given trait or phenotype. Any genetic trait may be analysed by the association method proposed here by carefully selecting the individuals to be included in the trait positive and trait negative phenotypic groups. Four criteria are often useful: clinical phenotype, age at onset, family history and severity. The selection procedure for continuous or quantitative traits (such as blood pressure for example) involves selecting individuals at opposite ends of the phenotype distribution of the trait under study, so as to include in these trait positive and trait negative populations individuals with non-overlapping phenotypes. Preferably, case-control populations consist of phenotypically homogeneous populations. Trait positive and trait negative populations consist of phenotypically uniform populations of individuals representing each between 1 and 98%, preferably between 1 and 80%, more preferably between 1 and 50%, and more preferably between 1 and 30%, most preferably between 1 and 20% of the total population under study, and selected among individuals exhibiting non-overlapping phenotypes. The clearer the difference between the two trait phenotypes, the greater the probability of detecting an association with biallelic markers. The selection of those drastically different but relatively uniform phenotypes enables efficient comparisons in association studies and the possible detection of marked differences at the genetic level, provided that the sample sizes of the populations under study are significant enough.

In preferred embodiments, a first group of between 50 and 300 trait positive individuals, preferably about 100 individuals, are recruited according to their phenotypes. A similar number of trait negative individuals are included in such studies.

Association Analysis

The general strategy to perform association studies using biallelic markers derived from a region carrying a candidate gene is to scan two groups of individuals (case-control populations) in order to measure and statistically compare the allele frequencies of the biallelic markers of the present invention in both groups.

If a statistically significant association with a trait is identified for at least one or more of the analysed biallelic markers, one can assume that: either the associated allele is directly responsible for causing the trait (the associated allele is the trait causing allele), or more likely the associated allele is in linkage disequilibrium with the trait causing allele. The specific characteristics of the associated allele with respect to the candidate gene function usually gives further insight into the relationship between the associated allele and the trait (causal or in linkage disequilibrium). If the evidence indicates that the associated allele within the candidate gene is most probably not the trait causing allele but is in linkage disequilibrium with the real trait causing allele, then the trait causing allele can be found by sequencing the vicinity of the associated marker.

Association studies are usually run in two successive steps. In a first phase, the frequencies of a reduced number of biallelic markers from one or several candidate genes are determined in the trait positive and trait negative populations. In a second phase of the analysis, the identity of the candidate gene and the position of the genetic loci responsible for the given trait is further refined using a higher density of markers from the relevant region. However, if the candidate gene under study is relatively small in length, as it is the case for many of the candidate genes analysed included in the present invention, a single phase may be sufficient to establish significant associations.

Haplotype Analysis

As described above, when a chromosome carrying a disease allele first appears in a population as a result of either mutation or migration, the mutant allele necessarily resides on a chromosome having a set of linked markers: the ancestral haplotype. This haplotype can be tracked through populations and its statistical association with a given trait can be analysed. Complementing single point (allelic) association studies with multi-point association studies also called haplotype studies increases the statistical power of association studies. Thus, a haplotype association study allows one to define the frequency and the type of the ancestral carrier haplotype. A haplotype analysis is important in that it increases the statistical power of an analysis involving individual markers.

In a first stage of a haplotype frequency analysis, the frequency of the possible haplotypes based on various combinations of the identified biallelic markers of the invention is determined. The haplotype frequency is then compared for distinct populations of trait positive and control individuals. The number of trait positive individuals, which should be, subjected to this analysis to obtain statistically significant results usually ranges between 30 and 300, with a preferred number of individuals ranging between 50 and 150. The same considerations apply to the number of unaffected individuals (or random control) used in the study. The results of this first analysis provide haplotype frequencies in case-control populations, for each evaluated haplotype frequency a p-value and an odd ratio are calculated. If a statistically significant association is found the relative risk for an individual carrying the given haplotype of being affected with the trait under study can be approximated.

Interaction Analysis

The biallelic markers of the present invention may also be used to identify patterns of biallelic markers associated with detectable traits resulting from polygenic interactions. The analysis of genetic interaction between alleles at unlinked loci requires individual genotyping using the techniques described herein. The analysis of allelic interaction among a selected set of biallelic markers with appropriate level of statistical significance can be considered as a haplotype analysis. Interaction analysis consists in stratifying the case-control populations with respect to a given haplotype for the first loci and performing a haplotype analysis with the second loci with each subpopulation.

Statistical methods used in association studies are further described below in IV.C.

4) Testing for Linkage in the Presence of Association

The biallelic markers of the present invention may further be used in TDT (transmission/disequilibrium test). TDT tests for both linkage and association and is not affected by population stratification. TDT requires data for affected individuals and their parents or data from unaffected sibs instead of from parents (see Spielmann S. et al., *Am. J. Hum. Genet.*, 52:506–516, 1993; Schaid D. J. et al., *Genet. Epidemiol.*, 13:423–450, 1996, Spielmann S. and Ewens W. J., *Am. J. Hum. Genet.*, 62:450–458, 1998, the disclosures of which are incorporated herein by reference in their entireties). Such combined tests generally reduce the false—positive errors produced by separate analyses.

IV.C. Statistical Methods

In general, any method known in the art to test whether a trait and a genotype show a statistically significant correlation may be used.

1) Methods in Linkage Analysis

Statistical methods and computer programs useful for linkage analysis are well-known to those skilled in the art (see Terwilliger J. D. and Ott J., *Handbook of Human Genetic Linkage*, John Hopkins University Press, London, 1994; Ott J., *Analysis of Human Genetic Linkage*, John Hopkins University Press, Baltimore, 1991, the disclosures of which are incorporated herein by reference in their entireties).

2) Methods to Estimate Haplotype Frequencies in a Population

As described above, when genotypes are scored, it is often not possible to distinguish heterozygotes so that haplotype frequencies cannot be easily inferred. When the gametic phase is not known, haplotype frequencies can be estimated from the multilocus genotypic data. Any method known to person skilled in the art can be used to estimate haplotype frequencies (see Lange K., *Mathematical and Statistical Methods for Genetic Analysis*, Springer, N.Y. 1997; Weir, B. S., *Genetic data Analysis II: Methods for Discrete population genetic Data*, Sinauer Assoc., Inc., Sunderland, Mass., USA, 1996, the disclosures of which are incorporated herein by reference in their entireties) Preferably, maximum-likelihood haplotype frequencies are computed using an Expectation-Maximization (EM) algorithm (see Dempster et al., *J. R. Stat. Soc.*, 39B:1–38, 1977; Excoffier L. and Slatkin M., *Mol. Biol. Evol.*, 12(5): 921–927, 1995, the disclosures of which are incorporated herein by reference in their entireties). This procedure is an iterative process aiming at obtaining maximum-likelihood estimates of haplotype frequencies from multi-locus genotype data when the gametic phase is unknown. Haplotype estimations are usually performed by applying the EM algorithm using for example the EM-HAPLO program (Hawley M. E. et al., *Am. J. Phys. Anthropol.*, 18:104, 1994, the disclosure of which is incorporated herein by reference in its entirety) or the Arlequin program (Schneider et al., *Arlequin: a software for population genetics data analysis*, University of Geneva, 1997, the disclosure of which is incorporated herein by reference in its entirety). The EM algorithm is a generalised iterative maximum likelihood approach to estimation and is briefly described below.

In the following part of this text, phenotypes will refer to multi-locus genotypes with unknown phase. Genotypes will refer to known-phase multi-locus genotypes.

Suppose a sample of N unrelated individuals typed for K markers. The data observed are the unknown-phase K-locus phenotypes that can categorised in F different phenotypes. Suppose that we have H underlying possible haplotypes (in case of K biallelic markers, $H=2^K$). For phenotype j, suppose that $c_j$ genotypes are possible. We thus have the following equation $$Pj = \sum_{i=1}^{c_j} pr(genotype_i) = \sum_{i=1}^{c_j} pr(h_k, h_l) \qquad \text{Equation 1}$$

where $P_j$ is the probability of the phenotypes, $h_k$ and $h_l$ are the two haplotypes constituent the genotype i. Under the Hardy-Weinberg equilibrium, $pr(h_k h_l)$ becomes:

$$pr(h_k,h_l)=pr(h_k)^2 \text{ if } h_k=h_l, pr(h_k,h_l)=$$
$$2pr(h_k).pr(h_l) \text{ if } h_k \neq h_l. \qquad \text{Equation 2}$$

The successive steps of the E-M algorithm can be described as follows: Starting with initial values of the of haplotypes frequencies, noted $p_1^{(0)}$, $p_2^{(0)}$, ... $P_H^{(0)}$, these initial values serve to estimate the genotype frequencies (Expectation step) and then estimate another set of haplotype frequencies (Maximisation step), noted $p_1^{(1)}$, $p_2^{(1)}$, ...

$p_H^{(1)}$, these two steps are iterated until changes in the sets of haplotypes frequency are very small.

A stop criterion can be that the maximum difference between haplotype frequencies between two iterations is less than $10^{-7}$. These values can be adjusted according to the desired precision of estimations.

In details, at a given iteration s, the Expectation step consists in calculating the genotypes frequencies by the following equation:

$$pr(genotype_i)^{(s)} = \qquad \text{Equation 3}$$
$$pr(phenotype_j) \cdot pr(genotype_i \mid phenotype_j)^{(s)} =$$
$$\frac{n_j}{N} \cdot \frac{pr(h_k, h_l)^{(s)}}{p_j^{(s)}}$$

where genotype i occurs in phenotype j, and where $h_k$ and $h_l$ constitute genotype i. Each probability is derived according to eq.1, and eq.2 described above.

Then the Maximisation step simply estimates another set of haplotype frequencies given the genotypes frequencies. This approach is also known as gene-counting method (Smith, *Ann. Hum. Genet.*, 21:254–276, 1957, the disclosure of which is incorporated herein by reference in its entirety).

$$p_t^{(s+1)} = \frac{1}{2} \sum_{j=1}^{F} \sum_{i=1}^{c_j} \delta_{it} \cdot pr(genotype_i)^{(s)} \qquad \text{Equation 4}$$

Where $\delta_{it}$ is an indicator variable which count the number of time haplotype t in genotype i. It takes the values of 0, 1 or 2.

To ensure that the estimation finally obtained is the maximum-likelihood estimation several values of departures are required. The estimations obtained are compared and if they are different the estimations leading to the best likelihood are kept.

3) Methods to Calculate Linkage Disequilibrium Between Markers

A number of methods can be used to calculate linkage disequilibrium between any two genetic positions, in practice linkage disequilibrium is measured by applying a statistical association test to haplotype data taken from a population.

Linkage disequilibrium between any pair of biallelic markers comprising at least one of the biallelic markers of the present invention ($M_i$, $M_j$) having alleles ($a_i/b_i$) at marker $M_i$ and alleles ($a_j/b_j$) at marker $M_j$ can be calculated for every allele combination ($a_i,a_j$; $a_i,b_j$; $b_i,a_j$ and $b_i,b_j$), according to the Piazza formula:

$$\Delta_{a_ia_j} = \sqrt{\theta 4} - \sqrt{(\theta 4 + \theta 3)(\theta 4 + \theta 2)}, \text{ where:}$$

θ4=−−=frequency of genotypes not having allele $a_i$ at $M_i$ and not having allele $a_j$ at $M_j$ θ3=−+=frequency of genotypes not having allele $a_i$ at $M_i$ and having allele $a_j$ at $M_j$ θ2=−+=frequency of genotypes having allele $a_i$ at $M_i$ and not having allele $a_j$ at $M_j$ Linkage disequilibrium (LD) between pairs of biallelic markers ($M_i$, $M_j$) can also be calculated for every allele combination ($a_i,a_j$; $a_i,b_j$; $b_i,a_j$ and $b_i,b_j$), according to the maximum-likelihood estimate (MLE) for delta (the composite genotypic disequilibrium coefficient), as described by Weir (Weir B. S., *Genetic Data Analysis, Sinauer Ass. Eds*, 1996, the disclosure of which is incorporated herein by reference in its entirety). The MLE for the composite linkage disequilibrium is:

$$D_{a_ia_j} = (2n_1 + n_2 + n_3 + n_4/2)/N - 2(pr(a_i) \cdot pr(a_j))$$

Where $n_1 = \Sigma$ phenotype ($a_i/a_i$, $a_j/a_j$), $n_2 = \Sigma$ phenotype ($a_i/a_i$, $a_j/b_j$), $n_3 = \Sigma$ phenotype ($a_i/b_i$, $a_j/a_j$), $n_4 = \Sigma$ phenotype ($a_i/b_i$, $a_j/b_j$) and N is the number of individuals in the sample. This formula allows linkage disequilibrium between alleles to be estimated when only genotype, and not haplotype, data are available.

Another means of calculating the linkage disequilibrium between markers is as follows. For a couple of biallelic markers, $M_i$ ($a_i/b_i$) and $M_j$ ($a_j/b_j$), fitting the Hardy-Weinberg equilibrium, one can estimate the four possible haplotype frequencies in a given population according to the approach described above.

The estimation of gametic disequilibrium between $a_i$ and $a_j$ is simply:

$$D_{a_ia_j} = pr(\text{haplotype}(a_i,a_j)) - pr(a_i) \cdot pr(a_j).$$

Where $pr(a_i)$ is the probability of allele $a_i$ and $pr(a_j)$ is the probability of allele $a_j$ and where pr(haplotype ($a_i,a_j$)) is estimated as in Equation 3 above. For a couple of biallelic marker only one measure of disequilibrium is necessary to describe the association between $M_i$ and $M_j$.

Then a normalised value of the above is calculated as follows:

$$D'_{a_ia_j} = D_{a_ia_j}/\max(-pr(a_i) \cdot pr(a_j), -pr(b_i) \cdot pr(b_j)) \text{ with } D_{a_ia_j} < 0$$

$$D'_{a_ia_j} = D_{a_ia_j}/\max(pr(b_i) \cdot pr(a_j), pr(a_i) \cdot pr(b_j)) \text{ with } D_{a_ia_j} < 0$$

The skilled person will readily appreciate that other LD calculation methods can be used without undue experimentation.

Linkage disequilibrium among a set of biallelic markers having an adequate heterozygosity rate can be determined by genotyping between 50 and 1000 unrelated individuals, preferably between 75 and 200, more preferably around 100.

4) Testing for Association

Methods for determining the statistical significance of a correlation between a phenotype and a genotype, in this case an allele at a biallelic marker or a haplotype made up of such alleles, may be determined by any statistical test known in the art and with any accepted threshold of statistical significance being required. The application of particular methods and thresholds of significance are well with in the skill of the ordinary practitioner of the art.

Testing for association is performed by determining the frequency of a biallelic marker allele in case and control populations and comparing these frequencies with a statistical test to determine if their is a statistically significant difference in frequency which would indicate a correlation between the trait and the biallelic marker allele under study. Similarly, a haplotype analysis is performed by estimating the frequencies of all possible haplotypes for a given set of biallelic markers in case and control populations, and comparing these frequencies with a statistical test to determine if their is a statistically significant correlation between the haplotype and the phenotype (trait) under study. Any statistical tool useful to test for a statistically significant association between a genotype and a phenotype may be used. Preferably the statistical test employed is a chi-square test with one degree of freedom. A p-value is calculated (the p-value is the probability that a statistic as large or larger than the observed one would occur by chance).

Statistical Significance

In preferred embodiments, significance for diagnosis purposes, either as a positive basis for further diagnostic tests or as a preliminary starting point for early preventive therapy, the p value related to a biallelic marker association is preferably about $1 \times 10^{-2}$ or less, more preferably about $1 \times 10^{-4}$ or less, for a single biallelic marker analysis and about $1 \times 10^{-3}$ or less, still more preferably $1 \times 10^{-6}$ or less and most preferably of about $1 \times 10^{-8}$ or less, for a haplotype analysis involving several markers. These values are believed to be applicable to any association studies involving single or multiple marker combinations.

The skilled person can use the range of values set forth above as a starting point in order to carry out association studies with biallelic markers of the present invention. In doing so, significant associations between the biallelic markers of the present invention and diseases can be revealed.

Phenotypic Permutation

In order to confirm the statistical significance of the first stage haplotype analysis described above, it might be suitable to perform further analyses in which genotyping data from case-control individuals are pooled and randomised with respect to the trait phenotype. Each individual genotyping data is randomly allocated to two groups, which contain the same number of individuals as the case-control populations used to compile the data obtained in the first stage. A second stage haplotype analysis is preferably run on these artificial groups, preferably for the markers included in the haplotype of the first stage analysis showing the highest relative risk coefficient. This experiment is reiterated preferably at least between 100 and 10000 times. The repeated iterations allow the determination of the percentage of obtained haplotypes with a significant p-value level.

Assessment of Statistical Association

To address the problem of false positives similar analysis may be performed with the same case-control populations in random genomic regions. Results in random regions and the candidate region are compared as described in US Provisional Patent Application entitled "Methods, software and apparati for identifying genomic regions harbouring a gene associated with a detectable trait".

5) Evaluation of Risk Factors

The association between a risk factor (in genetic epidemiology the risk factor is the presence or the absence of a certain allele or haplotype at marker loci) and a disease is measured by the odds ratio (OR) and by the relative risk (RR). If $P(R^+)$ is the probability of developing the disease for individuals with R and $P(R^-)$ is the probability for individuals without the risk factor, then the relative risk is simply the ratio of the two probabilities, that is:

$$RR=P(R^+)/P(R^-)$$

In case-control studies, direct measures of the relative risk cannot be obtained because of the sampling design. However, the odds ratio allows a good approximation of the relative risk for low-incidence diseases and can be calculated:

$$OR = \left[\frac{F^+}{1-F^+}\right] / \left[\frac{F^-}{(1-F^-)}\right]$$

$F^+$ is the frequency of the exposure to the risk factor in cases and $F^-$ is the frequency of the exposure to the risk factor in controls. $F^+$ and $F^-$ are calculated using the allelic or haplotype frequencies of the study and further depend on the underlying genetic model (dominant, recessive, additive . . .).

One can further estimate the attributable risk (AR) which describes the proportion of individuals in a population exhibiting a trait due to a given risk factor. This measure is important in quantitating the role of a specific factor in disease etiology and in terms of the public health impact of a risk factor. The public health relevance of this measure lies in estimating the proportion of cases of disease in the population that could be prevented if the exposure of interest were absent. AR is determined as follows:

$$AR=P_E(RR-1)/(P_E(RR-1)+1)$$

AR is the risk attributable to a biallelic marker allele or a biallelic marker haplotype. $P_E$ is the frequency of exposure to an allele or a haplotype within the population at large; and RR is the relative risk which, is approximated with the odds ratio when the trait under study has a relatively low incidence in the general population.

IV.F. Identification Of Biallelic Markers In Linkage Disequilibrium With The Biallelic Markers of the Invention Once a first biallelic marker has been identified in a genomic region of interest, the practitioner of ordinary skill in the art, using the teachings of the present invention, can easily identify additional biallelic markers in linkage disequilibrium with this first marker. As mentioned before any marker in linkage disequilibrium with a first marker associated with a trait will be associated with the trait. Therefore, once an association has been demonstrated between a given biallelic marker and a trait, the discovery of additional biallelic markers associated with this trait is of great interest in order to increase the density of biallelic markers in this particular region. The causal gene or mutation will be found in the vicinity of the marker or set of markers showing the highest correlation with the trait.

Identification of additional markers in linkage disequilibrium with a given marker involves: (a) amplifying a genomic fragment comprising a first biallelic marker from a plurality of individuals; (b) identifying of second biallelic markers in the genomic region harboring said first biallelic marker; (c) conducting a linkage disequilibrium analysis between said first biallelic marker and second biallelic markers; and (d) selecting said second biallelic markers as being in linkage disequilibrium with said first marker. Subcombinations comprising steps (b) and (c) are also contemplated.

Methods to identify biallelic markers and to conduct linkage disequilibrium analysis are described herein and can be carried out by the skilled person without undue experimentation. The present invention then also concerns biallelic markers which are in linkage disequilibrium with any of the specific biallelic markers of SEQ ID Nos. 1 to 3908, 1 to 2260, 2261 to 3374, and 3735 to 3908 and which are expected to present similar characteristics in terms of their respective association with a given trait.

Example 5 illustrates the measurement of linkage disequilibrium between a publicly known biallelic marker, the "ApoE Site A", located within the Alzheimer's related ApoE gene, and other biallelic markers randomly derived from the genomic region containing the ApoE gene.

IV.G. Identification Of Functional Mutations

Once a positive association is confirmed with a biallelic marker of the present invention, the associated candidate gene can be scanned for mutations by comparing the sequences of a selected number of trait positive and trait negative individuals. In a preferred embodiment, functional regions such as exons and splice sites, promoters and other regulatory regions of the candidate gene are scanned for mutations. Preferably, trait positive individuals carry the haplotype shown to be associated with the trait and trait negative individuals do not carry the haplotype or allele associated with the trait. The mutation detection procedure is essentially similar to that used for biallelic site identification.

The method used to detect such mutations generally comprises the following steps: (a) amplification of a region of the candidate gene comprising a biallelic marker or a group of biallelic markers associated with the trait from DNA samples of trait positive patients and trait negative controls; (b) sequencing of the amplified region; (c) comparison of DNA sequences from trait-positive patients and trait-negative controls; and (d) determination of mutations specific to trait-positive patients. Subcombinations which comprise steps (b) and (c) are specifically contemplated.

It is preferred that candidate polymorphisms be then verified by screening a larger population of cases and controls by means of any genotyping procedure such as those described herein, preferably using a microsequencing technique in an individual test format. Polymorphisms are considered as candidate mutations when present in cases and controls at frequencies compatible with the expected association results.

V. Biallelic Markers Of The Invention In Methods Of Genetic Diagnostics

The biallelic markers of the present invention can also be used to develop diagnostics tests capable of identifying individuals who express a detectable trait as the result of a specific genotype or individuals whose genotype places them at risk of developing a detectable trait at a subsequent time. The trait analyzed using the present diagnostics may be any detectable trait, including a disease, a response to an agent acting on a disease, or side effects to an agent acting on a disease.

The diagnostic techniques of the present invention may employ a variety of methodologies to determine whether a test subject has a biallelic marker pattern associated with an increased risk of developing a detectable trait or whether the individual suffers from a detectable trait as a result of a particular mutation, including methods which enable the analysis of individual chromosomes for haplotyping, such as family studies, single sperm DNA analysis or somatic hybrids.

The present invention provides diagnostic methods to determine whether an individual is at risk of developing a disease or suffers from a disease resulting from a mutation or a polymorphism in a candidate gene of the present invention. The present invention also provides methods to determine whether an individual is likely to respond positively to an agent acting on a disease or whether an individual is at risk of developing an adverse side effect to an agent acting on a disease.

These methods involve obtaining a nucleic acid sample from the individual and, determining, whether the nucleic acid sample contains at least one allele or at least one biallelic marker haplotype, indicative of a risk of developing the trait or indicative that the individual expresses the trait as a result of possessing a particular candidate gene polymorphism or mutation (trait-causing allele).

Preferably, in such diagnostic methods, a nucleic acid sample is obtained from the individual and this sample is genotyped using methods described above in III. The diagnostics may be based on a single biallelic marker or a on group of biallelic markers.

In each of these methods, a nucleic acid sample is obtained from the test subject and the biallelic marker pattern of one or more of the biallelic markers of SEQ ID Nos. 1 to 3908, 1 to 2260, 2261 to 3374, and 3735 to 3908 is determined.

In one embodiment, a PCR amplification is conducted on the nucleic acid sample to amplify regions in which polymorphisms associated with a detectable phenotype have been identified. The amplification products are sequenced to determine whether the individual possesses one or more polymorphisms associated with a detectable phenotype. The primers used to generate amplification products may comprise the primers of SEQ ID Nos. 3935 to 7842, 3935 to 6194, 6195 to 7668, 7669 to 7842, 7866 to 11773, 7866 to 10125, 10126 to 11599, and 11600 to 11773. Alternatively, the nucleic acid sample is subjected to microsequencing reactions as described above to determine whether the individual possesses one or more polymorphisms associated with a detectable phenotype resulting from a mutation or a polymorphism in a candidate gene. In another embodiment, the nucleic acid sample is contacted with one or more allele specific oligonucleotide probes which, specifically hybridize to one or more candidate gene alleles associated with a detectable phenotype.

These diagnostic methods are extremely valuable as they can, in certain circumstances, be used to initiate preventive treatments or to allow an individual carrying a significant haplotype to foresee warning signs such as minor symptoms. In diseases in which attacks may be extremely violent and sometimes fatal if not treated on time, such as disease, the knowledge of a potential predisposition, even if this predisposition is not absolute, might contribute in a very significant manner to treatment efficacy. Similarly, a diagnosed predisposition to a potential side effect could immediately direct the physician toward a treatment for which such side effects have not been observed during clinical trials.

Diagnostics, which analyze and predict response to a drug or side effects to a drug, may be used to determine whether an individual should be treated with a particular drug. For example, if the diagnostic indicates a likelihood that an individual will respond positively to treatment with a particular drug, the drug may be administered to the individual. Conversely, if the diagnostic indicates that an individual is likely to respond negatively to treatment with a particular drug, an alternative course of treatment may be prescribed. A negative response may be defined as either the absence of an efficacious response or the presence of toxic side effects.

Clinical drug trials represent another application for the markers of the present invention. One or more markers indicative of response to an agent acting on a disease or to side effects to an agent acting on a disease may be identified using the methods described above. Thereafter, potential participants in clinical trials of such an agent may be screened to identify those individuals most likely to respond favorably to the drug and exclude those likely to experience side effects. In that way, the effectiveness of drug treatment may be measured in individuals who respond positively to the drug, without lowering the measurement as a result of the inclusion of individuals who are unlikely to respond positively in the study and without risking undesirable safety problems.

VI. Computer-Related Embodiments

In some embodiments of the present invention a computer to based system may support the on-line coordination between the identification of biallelic markers and the corresponding analysis of their frequency in the different groups.

As used herein the term "nucleic acid codes of SEQ ID NOs. 1 to 3908, 1 to 2260, 2261 to 3374, 3735 to 3908, 3935 to 7842, 3935 to 6194, 6195 to 7668, 7669 to 7842, 7866 to 11773, 7866 to 10125, 10126 to 11599, and 11600 to 11773" encompasses the nucleotide sequences of SEQ ID NOs. 1 to 3908, 1 to 2260, 2261 to 3374, 3735 to 3908, 3935 to 7842, 3935 to 6194, 6195 to 7668, 7669 to 7842, 7866 to 11773, 7866 to 10125, 10126 to 11599, and 11600 to 11773, fragments of SEQ ID NOs. 1 to 3908, 1 to 2260, 2261 to 3374, 3735 to 3908, 3935 to 7842, 3935 to 6194, 6195 to 7668, 7669 to 7842, 7866 to 11773, 7866 to 10125, 10126 to 11599, and 11600 to 11773, nucleotide sequences homologous to SEQ ID NOs. 1 to 3908, 1 to 2260, 2261 to 3374, 3735 to 3908, 3935 to 7842, 3935 to 6194, 6195 to 7668, 7669 to 7842, 7866 to 11773, 7866 to 10125, 10126 to 11599, and 11600 to 11773 or homologous to fragments of SEQ ID NOs. 1 to 3908, 1 to 2260, 2261 to 3374, 3735 to 3908, 3935 to 7842, 3935 to 6194, 6195 to 7668, 7669 to 7842, 7866 to 11773, 7866 to 10125, 10126 to 11599, and 11600 to 11773, and sequences complementary to all of the preceding sequences. As used herein the term "nucleic acid codes of SEQ ID NOs. 1 to 3908, 1 to 2260, 2261 to 3374, 3735 to 3908, 3935 to 7842, 3935 to 6194, 6195 to 7668, 7669 to 7842, 7866 to 11773, 7866 to 10125, 10126 to 11599, and 11600 to 11773" further encompasses the nucleotide sequences comprising, consisting essentially of, or consisting of any one of the following:

a) a contiguous span of at least 8, 10, 12, 15, 18, 19, 20, 22, 23, 24, 25, 30, 35, 43, 44, 45, 46 or 47 nucleotides, to the extent that a contiguous span of these lengths is consistent with the lengths of the particular Sequence ID, of any of SEQ ID Nos. 1 to 2260 or the complements thereof;

b) a contiguous span of at least 8, 10, 12, 15, 18, 19, 20, 22, 23, 24, 25, 30, 35, 43, 44, 45, 46 or 47 nucleotides, to the extent that a contiguous span of these lengths is consistent with the lengths of the particular Sequence ID, of any of SEQ ID Nos. 1 to 2260 or the complements thereof, further comprising the $1^{ST}$ allele of the polymorphic base of the respective SEQ ID number;

c) a contiguous span of at least 8, 10, 12, 15, 18, 19, 20, 22, 23, 24, 25, 30, 35, 43, 44, 45, 46 or 47 nucleotides, to the extent that a contiguous span of these lengths is consistent with the lengths of the particular Sequence ID, of any of SEQ ID Nos. 1 to 2260 or the complements thereof, further comprising the $2^{ND}$ allele of the polymorphic base of the respective SEQ ID number;

d) a contiguous span of at least 8, 10, 12, 15, 18, 19, 20, 22, 23, 24, 25, 30, 35, 43, 44, 45, 46 or 47 nucleotides, to the extent that a contiguous span of these lengths is consistent with the lengths of the particular Sequence ID, of any of SEQ ID Nos. 2261 to 3734 or the complements thereof;

e) a contiguous span of at least 8, 10, 12, 15, 18, 19, 20, 22, 23, 24, 25, 30, 35, 43, 44, 45, 46 or 47 nucleotides, to the extent that a contiguous span of these lengths is consistent with the lengths of the particular Sequence ID, of any of SEQ ID Nos. 2261 to 3734 or the complements thereof, further comprising the $1^{ST}$ allele of the polymorphic base of the respective SEQ ID number;

f) a contiguous span of at least 8, 10, 12, 15, 18, 19, 20, 22, 23, 24, 25, 30, 35, 43, 44, 45, 46 or 47 nucleotides, to the extent that a contiguous span of these lengths is consistent with the lengths of the particular Sequence ID, of any of SEQ ID Nos. 2261 to 3734 or the complements thereof, further comprising the $2^{ND}$ allele of the polymorphic base of the respective SEQ ID number;

g) a contiguous span of at least 8, 10, 12, 15, 18, 19, 20, 22, 23, 24, 25, 30, 35, 43, 44, 45, 46 or 47 nucleotides, to the extent that a contiguous span of these lengths is consistent with the lengths of the particular Sequence ID, of any of SEQ ID Nos. 3735 to 3908 or the complements thereof;

h) a contiguous span of at least 8, 10, 12, 15, 18, 19, 20, 22, 23, 24, 25, 30, 35, 43, 44, 45, 46 or 47 nucleotides, to the extent that a contiguous span of these lengths is consistent with the lengths of the particular Sequence ID, of any of SEQ ID Nos. 3735 to 3908 or the complements thereof, further comprising the $1^{ST}$ allele of the polymorphic base of the respective SEQ ID number;

i) a contiguous span of at least 8, 10, 12, 15, 18, 19, 20, 22, 23, 24, 25, 30, 35, 43, 44, 45, 46 or 47 nucleotides, to the extent that a contiguous span of these lengths is consistent with the lengths of the particular Sequence ID, of any of SEQ ID Nos. 3735 to 3908 or the complements thereof, further comprising the $2^{ND}$ allele of the polymorphic base of the respective SEQ ID number; and j) a contiguous span of at least 8, 10, 12, 15, 18, 19, 20, or 21 nucleotides, to the extent that a contiguous span of these lengths is consistent with the lengths of the particular Sequence ID, of any of SEQ ID Nos. 3935 to 7842, 3935 to 6194, 6195 to 7668, 7669 to 7842, 7866 to 11773, 7866 to 10125, 10126 to 11599, and 11600 to 11773 or the complements thereof.

The "nucleic acid codes of SEQ ID NOs. 1 to 3908, 1 to 2260, 2261 to 3374, 3735 to 3908, 3935 to 7842, 3935 to 6194, 6195 to 7668, 7669 to 7842, 7866 to 11773, 7866 to 10125, 10126 to 11599, and 11600 to 11773" further encompass nucleotide sequences homologous to:

a) a contiguous span of at least 8, 10, 12, 15, 18, 19, 20, 22, 23, 24, 25, 30, 35, 43, 44, 45, 46 or 47 nucleotides, to the extent that a contiguous span of these lengths is consistent with the lengths of the particular Sequence ID, of any of SEQ ID Nos. 1 to 2260 or the complements thereof;

b) a contiguous span of at least 8, 10, 12, 15, 18, 19, 20, 22, 23, 24, 25, 30, 35, 43, 44, 45, 46 or 47 nucleotides, to the extent that a contiguous span of these lengths is consistent with the lengths of the particular Sequence ID, of any of SEQ ID Nos. 1 to 2260 or the complements thereof, further comprising the $1^{ST}$ allele of the polymorphic base of the respective SEQ ID number;

c) a contiguous span of at least 8, 10, 12, 15, 18, 19, 20, 22, 23, 24, 25, 30, 35, 43, 44, 45, 46 or 47 nucleotides, to the extent that a contiguous span of these lengths is consistent with the lengths of the particular Sequence ID, of any of SEQ ID Nos. 1 to 2260 or the complements thereof, further comprising the $2^{ND}$ allele of the polymorphic base of the respective SEQ ID number;

d) a contiguous span of at least 8, 10, 12, 15, 18, 19, 20, 22, 23, 24, 25, 30, 35, 43, 44, 45, 46 or 47 nucleotides, to the extent that a contiguous span of these lengths is consistent with the lengths of the particular Sequence ID, of any of SEQ ID Nos. 2261 to 3734 or the complements thereof;

e) a contiguous span of at least 8, 10, 12, 15, 18, 19, 20, 22, 23, 24, 25, 30, 35, 43, 44, 45, 46 or 47 nucleotides, to the extent that a contiguous span of these lengths is consistent with the lengths of the particular Sequence ID, of any of SEQ ID Nos. 2261 to 3734 or the complements thereof, further comprising the $1^{ST}$ allele of the polymorphic base of the respective SEQ ID number;

f) a contiguous span of at least 8, 10, 12, 15, 18, 19, 20, 22, 23, 24, 25, 30, 35, 43, 44, 45, 46 or 47 nucleotides, to the extent that a contiguous span of these lengths is consistent with the lengths of the particular Sequence ID, of any of SEQ ID Nos. 2261 to 3734 or the complements thereof, further comprising the $2^{ND}$ allele of the polymorphic base of the respective SEQ ID number;

g) a contiguous span of at least 8, 10, 12, 15, 18, 19, 20, 22, 23, 24, 25, 30, 35, 43, 44, 45, 46 or 47 nucleotides, to the extent that a contiguous span of these lengths is consistent with the lengths of the particular Sequence ID, of any of SEQ ID Nos. 3735 to 3908 or the complements thereof;

h) a contiguous span of at least 8, 10, 12, 15, 18, 19, 20, 22, 23, 24, 25, 30, 35, 43, 44, 45, 46 or 47 nucleotides, to the extent that a contiguous span of these lengths is consistent with the lengths of the particular Sequence ID, of any of SEQ ID Nos. 3735 to 3908 or the complements thereof, further comprising the $1^{ST}$ allele of the polymorphic base of the respective SEQ ID number;

i) a contiguous span of at least 8, 10, 12, 15, 18, 19, 20, 22, 23, 24, 25, 30, 35, 43, 44, 45, 46 or 47 nucleotides, to the extent that a contiguous span of these lengths is consistent with the lengths of the particular Sequence ID, of any of SEQ ID Nos. 3735 to 3908 or the complements thereof, further comprising the $2^{ND}$ allele of the polymorphic base of the respective SEQ ID number; and j) a contiguous span of at least 8, 10, 12, 15, 18, 19, 20, or 21 nucleotides, to the extent that a contiguous span of these lengths is consistent with the lengths of the particular Sequence ID, of any of SEQ ID Nos. 3935 to 7842, 3935 to 6194, 6195 to 7668, 7669 to 7842, 7866 to 11773, 7866 to 10125, 10126 to 11599, and 11600 to 11773 or the complements thereof.

Homologous sequences refer to a sequence having at least 99%, 98%, 97%, 96%, 95%, 90%, 85%, 80%, or 75% homology to these contiguous spans. Homology may be determined using any method described herein, including BLAST2N with the default parameters or with any modified parameters. Homologous sequences also may include RNA sequences in which uridines replace the thymines in the nucleic acid codes of the invention. It will be appreciated that the nucleic acid codes of the invention can be represented in the traditional single character format (See the inside back cover of Stryer, Lubert. *Biochemistry*, $3^{rd}$ edition. W. H Freeman & Co., New York.) or in any other format or code which records the identity of the nucleotides in a sequence.

It should be noted that the nucleic acid codes of the invention further encompass all of the polynucleotides disclosed, described or claimed in the present application. Moveover, the present invention specifically contemplates computer readable media and computer systems wherein such codes are stored individually or in any combination.

It will be appreciated by those skilled in the art that the nucleic acid codes of SEQ ID Nos. 1 to 3908, 1 to 2260, 2261 to 3374, 3735 to 3908, 3935 to 7842, 3935 to 6194, 6195 to 7668, 7669 to 7842, 7866 to 11773, 7866 to 10125, 10126 to 11599, and 11600 to 11773 can be stored, recorded, and manipulated on any medium which can be read and accessed by a computer. As used herein, the words "recorded" and "stored" refer to a process for storing information on a computer medium. A skilled artisan can readily adopt any of the presently known methods for recording information on a computer readable medium to generate embodiments comprising one or more of the nucleic acid codes of SEQ ID Nos. 1 to 3908, 1 to 2260, 2261 to 3374, 3735 to 3908, 3935 to 7842, 3935 to 6194, 6195 to 7668, 7669 to 7842, 7866 to 11773, 7866 to 10125, 10126 to 11599, and 11600 to 11773. A particularly preferred embodiment of the present invention is a computer readable medium having recorded thereon at least 2, 5, 10, 15, 20, 25, 30, 50, 100, 200, 500, 1000, 2000, or 5000 nucleic acid codes of SEQ ID Nos. 1 to 3908, 1 to 2260, 2261 to 3374, 3735 to 3908, 3935 to 7842, 3935 to 6194, 6195 to 7668, 7669 to 7842, 7866 to 11773, 7866 to 10125, 10126 to 11599, and 11600 to 11773.

Computer readable media include magnetically readable media, optically readable media, electronically readable media and magnetic/optical media. For example, the computer readable media may be a hard disk, a floppy disk, a magnetic tape, CD-ROM, Digital Versatile Disk (DVD), Random Access Memory (RAM), or Read Only Memory (ROM) as well as other types of other media known to those skilled in the art.

Figure 14:
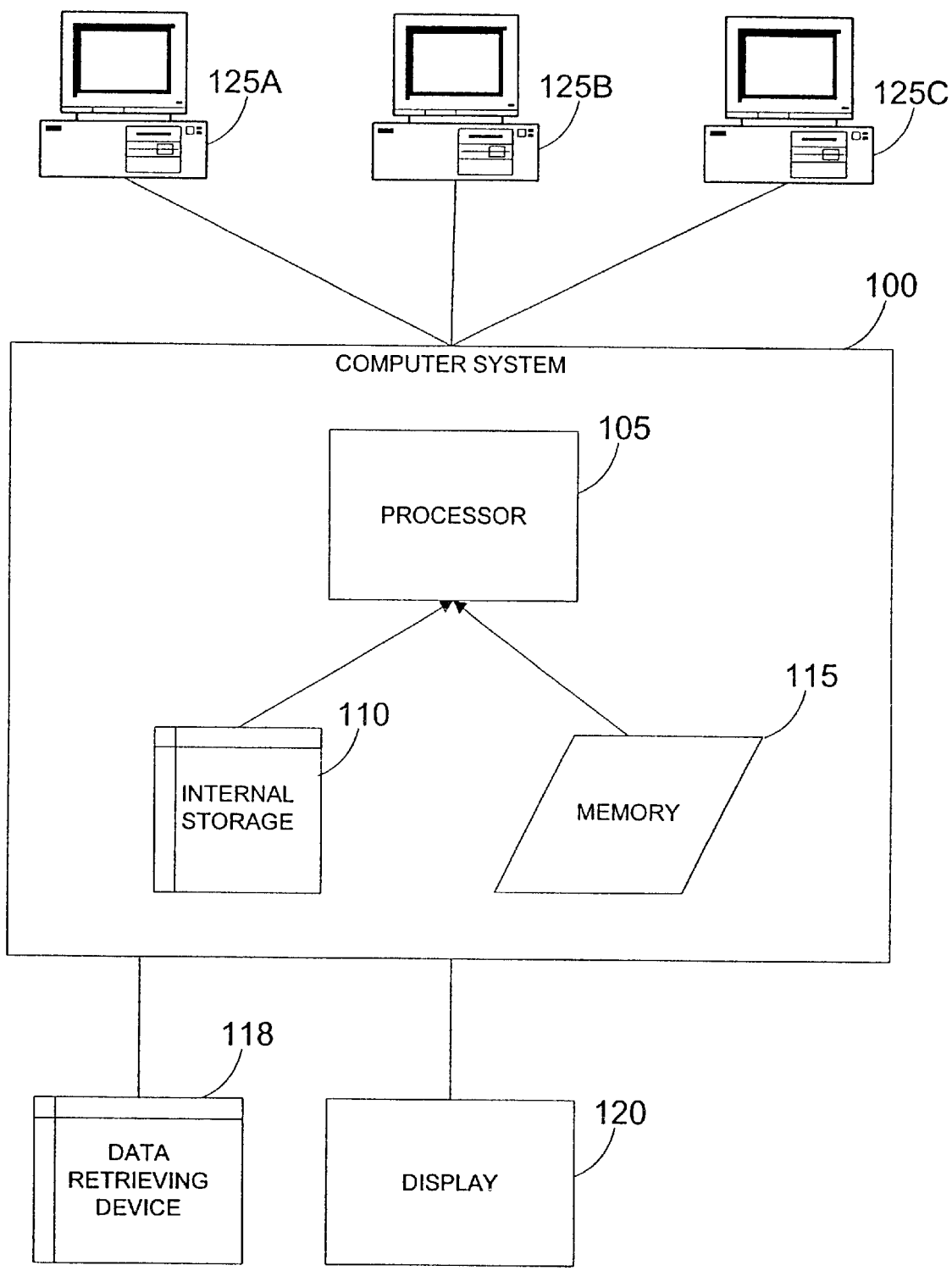
FIG. 14 is a block diagram of an exemplary computer system.

Embodiments of the present invention include systems, particularly computer systems which store and manipulate the sequence information described herein. One example of a computer system 100 is illustrated in block diagram form in FIG. 14. As used herein, "a computer system" refers to the hardware components, software components, and data storage components used to analyze the nucleotide sequences of the nucleic acid codes of SEQ ID NOs. 1 to 3908, 1 to 2260, 2261 to 3374, 3735 to 3908, 3935 to 7842, 3935 to 6194, 6195 to 7668, 7669 to 7842, 7866 to 11773, 7866 to 10125, 10126 to 11599, and 11600 to 11773. In one embodiment, the computer system 100 is a Sun Enterprise 1000 server (Sun Microsystems, Palo Alto, Calif.). The computer system 100 preferably includes a processor for processing, accessing and manipulating the sequence data. The processor 105 can be any well-known type of central processing unit, such as the Pentium III from Intel Corporation, or similar processor from Sun, Motorola, Compaq or International Business Machines.

Preferably, the computer system 100 is a general purpose system that comprises the processor 105 and one or more internal data storage components 110 for storing data, and one or more data retrieving devices for retrieving the data stored on the data storage components. A skilled artisan can readily appreciate that any one of the currently available computer systems are suitable.

In one particular embodiment, the computer system 100 includes a processor 105 connected to a bus which is connected to a main memory 115 (preferably implemented as RAM) and one or more internal data storage devices 110, such as a hard drive and/or other computer readable media having data recorded thereon. In some embodiments, the computer system 100 further includes one or more data retrieving device 118 for reading the data stored on the internal data storage devices 110.

The data retrieving device 118 may represent, for example, a floppy disk drive, a compact disk drive, a magnetic tape drive, etc. In some embodiments, the internal data storage device 110 is a removable computer readable medium such as a floppy disk, a compact disk, a magnetic tape, etc. containing control logic and/or data recorded thereon. The computer system 100 may advantageously include or be programmed by appropriate software for reading the control logic and/or the data from the data storage component once inserted in the data retrieving device.

The computer system 100 includes a display 120 which is used to display output to a computer user. It should also be noted that the computer system 100 can be linked to other computer systems 125*a–c* in a network or wide area network to provide centralized access to the computer system 100.

Software for accessing and processing the nucleotide sequences of the nucleic acid codes of SEQ ID Nos. 1 to 3908, 1 to 2260, 2261 to 3374, 3735 to 3908, 3935 to 7842, 3935 to 6194, 6195 to 7668, 7669 to 7842, 7866 to 11773, 7866 to 10125, 10126 to 11599, and 11600 to 11773 (such as search tools, compare tools, and modeling tools etc.) may reside in main memory 115 during execution.

In some embodiments, the computer system 100 may further comprise a sequence comparer for comparing the above-described nucleic acid codes of SEQ ID Nos. 1 to 3908, 1 to 2260, 2261 to 3374, 3735 to 3908, 3935 to 7842, 3935 to 6194, 6195 to 7668, 7669 to 7842, 7866 to 11773, 7866 to 10125, 10126 to 11599, and 11600 to 11773 stored on a computer readable medium to reference nucleotide or polypeptide sequences stored on a computer readable medium. A "sequence comparer" refers to one or more programs which are implemented on the computer system 100 to compare a nucleotide sequence with other nucleotide sequences and/or compounds stored within the data storage means. For example, the sequence comparer may compare the nucleotide sequences of the nucleic acid codes of SEQ ID Nos. 1 to 3908, 1 to 2260, 2261 to 3374, 3735 to 3908, 3935 to 7842, 3935 to 6194, 6195 to 7668, 7669 to 7842, 7866 to 11773, 7866 to 10125, 10126 to 11599, and 11600 to 11773 stored on a computer readable medium to reference sequences stored on a computer readable medium to identify homologies or structural motifs. The various sequence comparer programs identified elsewhere in this patent specification are particularly contemplated for use in this aspect of the invention.

Figure 15:
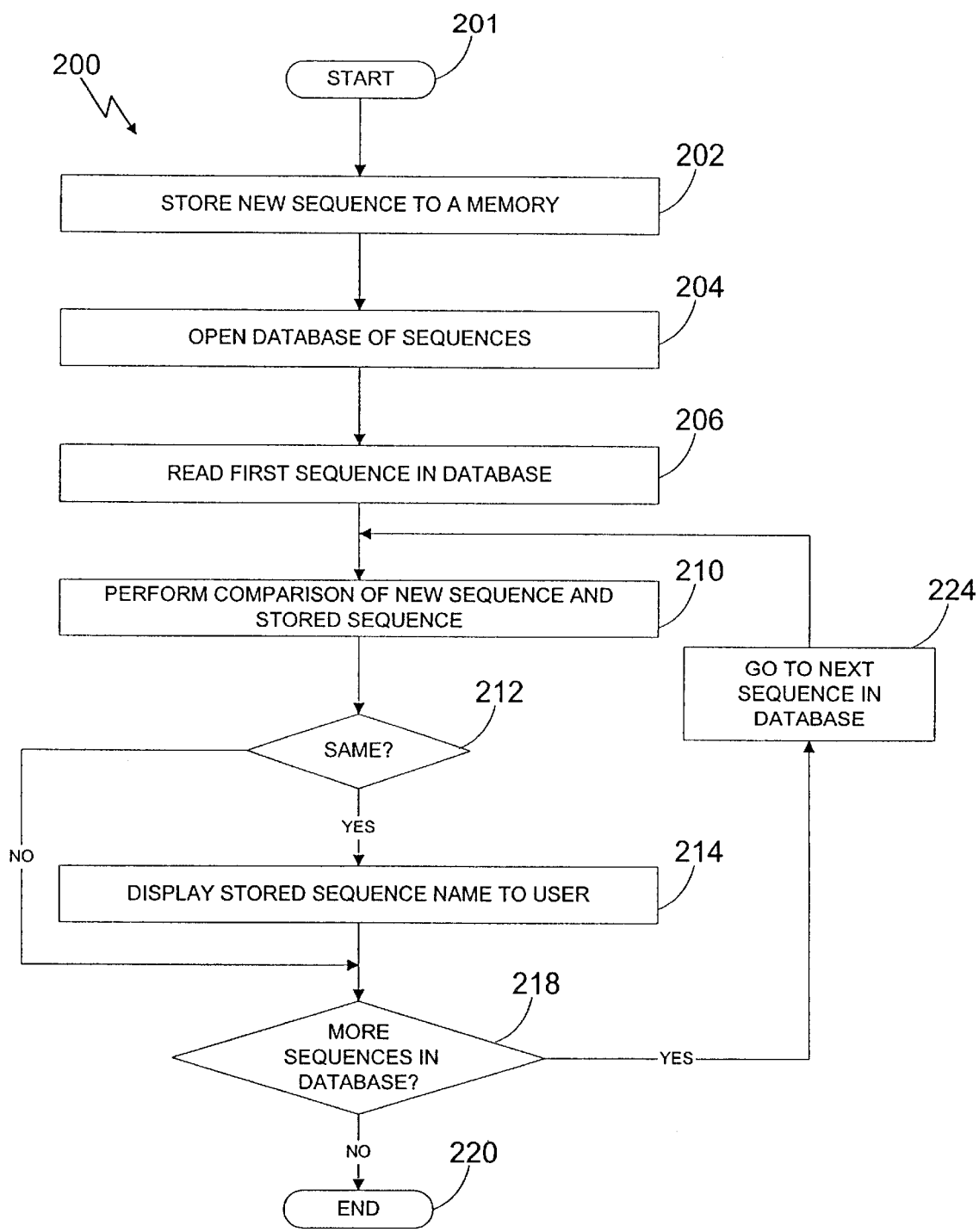
FIG. 15 is a flow diagram illustrating one embodiment of a process 200 for comparing a new nucleotide or protein sequence with a database of sequences in order to determine the homology levels between the new sequence and the sequences in the database.

FIG. 15 is a flow diagram illustrating one embodiment of a process 200 for comparing a new nucleotide or protein sequence with a database of sequences in order to determine the homology levels between the new sequence and the sequences in the database. The database of sequences can be a private database stored within the computer system 100, or a public database such as GENBANK that is available through the Internet.

The process 200 begins at a start state 201 and then moves to a state 202 wherein the new sequence to be compared is stored to a memory in a computer system 100. As discussed above, the memory could be any type of memory, including RAM or an internal storage device.

The process 200 then moves to a state 204 wherein a database of sequences is opened for analysis and comparison. The process 200 then moves to a state 206 wherein the first sequence stored in the database is read into a memory on the computer. A comparison is then performed at a state 210 to determine if the first sequence is the same as the second sequence. It is important to note that this step is not limited to performing an exact comparison between the new sequence and the first sequence in the database. Well-known methods are known to those of skill in the art for comparing two nucleotide or protein sequences, even if they are not identical. For example, gaps can be introduced into one sequence in order to raise the homology level between the two tested sequences. The parameters that control whether gaps or other features are introduced into a sequence during comparison are normally entered by the user of the computer system.

Once a comparison of the two sequences has been performed at the state 210, a determination is made at a decision state 210 whether the two sequences are the same. Of course, the term "same" is not limited to sequences that are absolutely identical. Sequences that are within the homology parameters entered by the user will be marked as "same" in the process 200.

If a determination is made that the two sequences are the same, the process 200 moves to a state 214 wherein the name of the sequence from the database is displayed to the user. This state notifies the user that the sequence with the displayed name fulfills the homology constraints that were entered. Once the name of the stored sequence is displayed to the user, the process 200 moves to a decision state 218 wherein a determination is made whether more sequences exist in the database. If no more sequences exist in the database, then the process 200 terminates at an end state 220. However, if more sequences do exist in the database, then the process 200 moves to a state 224 wherein a pointer is moved to the next sequence in the database so that it can be compared to the new sequence. In this manner, the new sequence is aligned and compared with every sequence in the database.

It should be noted that if a determination had been made at the decision state 212 that the sequences were not homologous, then the process 200 would move immediately to the decision state 218 in order to determine if any other sequences were available in the database for comparison.

Accordingly, one aspect of the present invention is a computer system comprising a processor, a data storage device having stored thereon a nucleic acid code of SEQ ID Nos. 1 to 3908, 1 to 2260, 2261 to 3374, 3735 to 3908, 3935 to 7842, 3935 to 6194, 6195 to 7668, 7669 to 7842, 7866 to 11773, 7866 to 10125, 10126 to 11599, and 11600 to 11773, a data storage device having retrievably stored thereon reference nucleotide sequences or polypeptide sequences to be compared to the nucleic acid code of SEQ ID Nos. 1 to 3908, 1 to 2260, 2261 to 3374, 3735 to 3908, 3935 to 7842, 3935 to 6194, 6195 to 7668, 7669 to 7842, 7866 to 11773, 7866 to 10125, 10126 to 11599, and 11600 to 11773 and a sequence comparer for conducting the comparison. The sequence comparer may indicate a homology level between the sequences compared or identify structural motifs in the above described nucleic acid code of SEQ ID Nos. 1 to 3908, 1 to 2260, 2261 to 3374, 3735 to 3908, 3935 to 7842, 3935 to 6194, 6195 to 7668, 7669 to 7842, 7866 to 11773, 7866 to 10125, 10126 to 11599, and 11600 to 11773 or it may identify structural motifs in sequences which are compared to these nucleic acid codes and polypeptide codes. In some embodiments, the data storage device may have stored thereon the sequences of at least 2, 5, 10, 15, 20, 25, 30, 50, 100, 200, 500, 1000, 2000, or 5000 of the nucleic acid codes of SEQ ID Nos. 1 to 3908, 1 to 2260, 2261 to 3374, 3735 to 3908, 3935 to 7842, 3935 to 6194, 6195 to 7668, 7669 to 7842, 7866 to 11773, 7866 to 10125, 10126 to 11599, and 11600 to 11773.

Another aspect of the present invention is a method for determining the level of homology between a nucleic acid code of SEQ ID NOs. 1 to 3908, 1 to 2260, 2261 to 3374, 3735 to 3908, 3935 to 7842, 3935 to 6194, 6195 to 7668, 7669 to 7842, 7866 to 11773, 7866 to 10125, 10126 to 11599, and 11600 to 11773 and a reference nucleotide sequence, comprising the steps of reading the nucleic acid code and the reference nucleotide sequence through the use of a computer program which determines homology levels and determining homology between the nucleic acid code and the reference nucleotide sequence with the computer program. The computer program may be any of a number of computer programs for determining homology levels, including those specifically enumerated herein, including BLAST2N with the default parameters or with any modified parameters. The method may be implemented using the computer systems described above. The method may also be performed by reading at least 2, 5, 10, 15, 20, 25, 30, 50, 100, 200, 500, 1000, 2000, or 5000 of the above described nucleic acid codes of SEQ ID NOs. 1 to 3908, 1 to 2260, 2261 to 3374, 3735 to 3908, 3935 to 7842, 3935 to 6194, 6195 to 7668, 7669 to 7842, 7866 to 11773, 7866 to 10125, 10126 to 11599, and 11600 to 11773 through use of the computer program and determining homology between the nucleic acid codes and reference nucleotide sequences.

Figure 16:
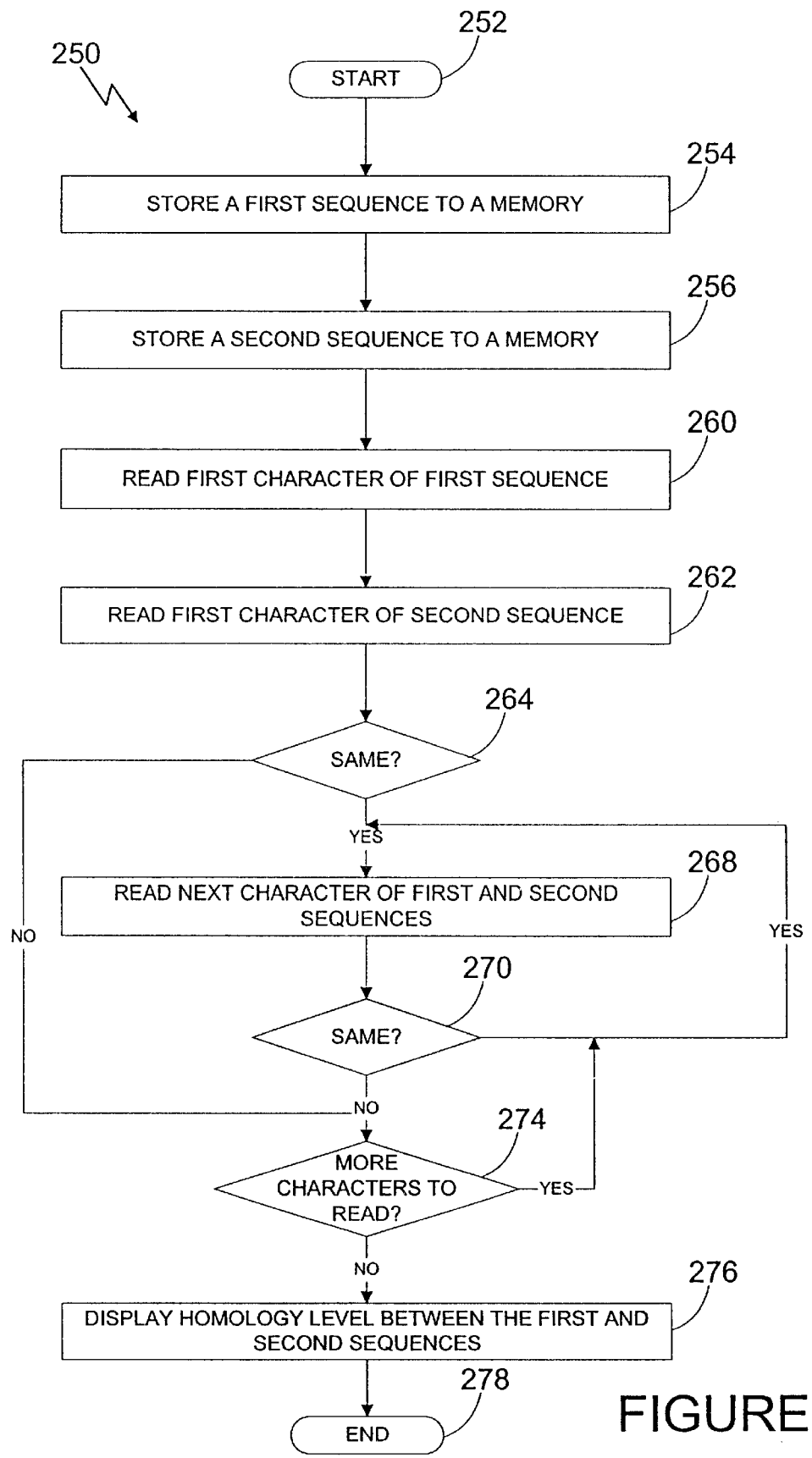
FIG. 16 is a flow diagram illustrating one embodiment of a process 250 in a computer for determining whether two sequences are homologous.

FIG. 16 is a flow diagram illustrating one embodiment of a process 250 in a computer for determining whether two sequences are homologous. The process 250 begins at a start state 252 and then moves to a state 254 wherein a first sequence to be compared is stored to a memory. The second sequence to be compared is then stored to a memory at a state 256. The process 250 then moves to a state 260 wherein the first character in the first sequence is read and then to a state 262 wherein the first character of the second sequence is read. It should be understood that if the sequence is a nucleotide sequence, then the character would normally be either A, T, C, G or U. If the sequence is a protein sequence, then it should be in the single letter amino acid code so that the first and sequence sequences can be easily compared.

A determination is then made at a decision state 264 whether the two characters are the same. If they are the same, then the process 250 moves to a state 268 wherein the next characters in the first and second sequences are read. A determination is then made whether the next characters are the same. If they are, then the process 250 continues this loop until two characters are not the same. If a determination is made that the next two characters are not the same, the process 250 moves to a decision state 274 to determine whether there are any more characters either sequence to read.

If there aren't any more characters to read, then the process 250 moves to a state 276 wherein the level of homology between the first and second sequences is displayed to the user. The level of homology is determined by calculating the proportion of characters between the sequences that were the same out of the total number of sequences in the first sequence. Thus, if every character in a first 100 nucleotide sequence aligned with a every character in a second sequence, the homology level would be 100%.

Alternatively, the computer program may be a computer program which compares the nucleotide sequences of the nucleic acid codes of the present invention, to reference nucleotide sequences in order to determine whether the nucleic acid code of SEQ ID NOs. 1 to 3908, 1 to 2260, 2261 to 3374, 3735 to 3908, 3935 to 7842, 3935 to 6194, 6195 to 7668, 7669 to 7842, 7866 to 11773, 7866 to 10125, 10126 to 11599, and 11600 to 11773 differs from a reference nucleic acid sequence at one or more positions. Optionally such a program records the length and identity of inserted, deleted or substituted nucleotides with respect to the sequence of either the reference polynucleotide or the nucleic acid code of SEQ ID NOs. 1 to 3908, 1 to 2260, 2261 to 3374, 3735 to 3908, 3935 to 7842, 3935 to 6194, 6195 to 7668, 7669 to 7842, 7866 to 11773, 7866 to 10125, 10126 to 11599, and 11600 to 11773. In one embodiment, the computer program may be a program which determines whether the nucleotide sequences of the nucleic acid codes of SEQ ID NOs. 1 to 3908, 1 to 2260, 2261 to 3374, 3735 to 3908, 3935 to 7842, 3935 to 6194, 6195 to 7668, 7669 to 7842, 7866 to 11773, 7866 to 10125, 10126 to 11599, and 11600 to 11773 contain a biallelic marker or single nucleotide polymorphism (SNP) with respect to a reference nucleotide sequence. This single nucleotide polymorphism may comprise a single base substitution, insertion, or deletion, while this biallelic marker may comprise about one to ten consecutive bases substituted, inserted or deleted.

Accordingly, another aspect of the present invention is a method for determining whether a nucleic acid code of SEQ ID NOs. 1 to 3908, 1 to 2260, 2261 to 3374, 3735 to 3908, 3935 to 7842, 3935 to 6194, 6195 to 7668, 7669 to 7842, 7866 to 11773, 7866 to 10125, 10126 to 11599, and 11600 to 11773 differs at one or more nucleotides from a reference nucleotide sequence comprising the steps of reading the nucleic acid code and the reference nucleotide sequence through use of a computer program which identifies differences between nucleic acid sequences and identifying differences between the nucleic acid code and the reference nucleotide sequence with the computer program. In some embodiments, the computer program is a program which identifies single nucleotide polymorphisms. The method may be implemented by the computer systems described above and the method illustrated in FIG. 16. The method may also be performed by reading at least 2, 5, 10, 15, 20, 25, 30, 50, 100, 200, 500, 1000, 2000, or 5000 of the nucleic acid codes of SEQ ID NOs. 1 to 3908, 1 to 2260, 2261 to 3374, 3735 to 3908, 3935 to 7842, 3935 to 6194, 6195 to 7668, 7669 to 7842, 7866 to 11773, 7866 to 10125, 10126 to 11599, and 11600 to 11773 and the reference nucleotide sequences through the use of the computer program and identifying differences between the nucleic acid codes and the reference nucleotide sequences with the computer program. In other embodiments the computer based system may further comprise an identifier for identifying features within the nucleotide sequences of the nucleic acid codes of SEQ ID NOs. 1 to 3908, 1 to 2260, 2261 to 3374, 3735 to 3908, 3935 to 7842, 3935 to 6194, 6195 to 7668, 7669 to 7842, 7866 to 11773, 7866 to 10125, 10126 to 11599, and 11600 to 11773.

An "identifier" refers to one or more programs which identifies certain features within the above-described nucleotide sequences of the nucleic acid codes of SEQ ID NOs. 1 to 3908, 1 to 2260, 2261 to 3374, 3735 to 3908, 3935 to 7842, 3935 to 6194, 6195 to 7668, 7669 to 7842, 7866 to 11773, 7866 to 10125, 10126 to 11599, and 11600 to 11773. In one embodiment, the identifier may comprise a program which identifies an open reading frame in the cDNAs codes of SEQ ID NOs. 1 to 3908, 1 to 2260, 2261 to 3374, 3735 to 3908, 3935 to 7842, 3935 to 6194, 6195 to 7668, 7669 to 7842, 7866 to 11773, 7866 to 10125, 10126 to 11599, and 11600 to 11773.

Figure 17:
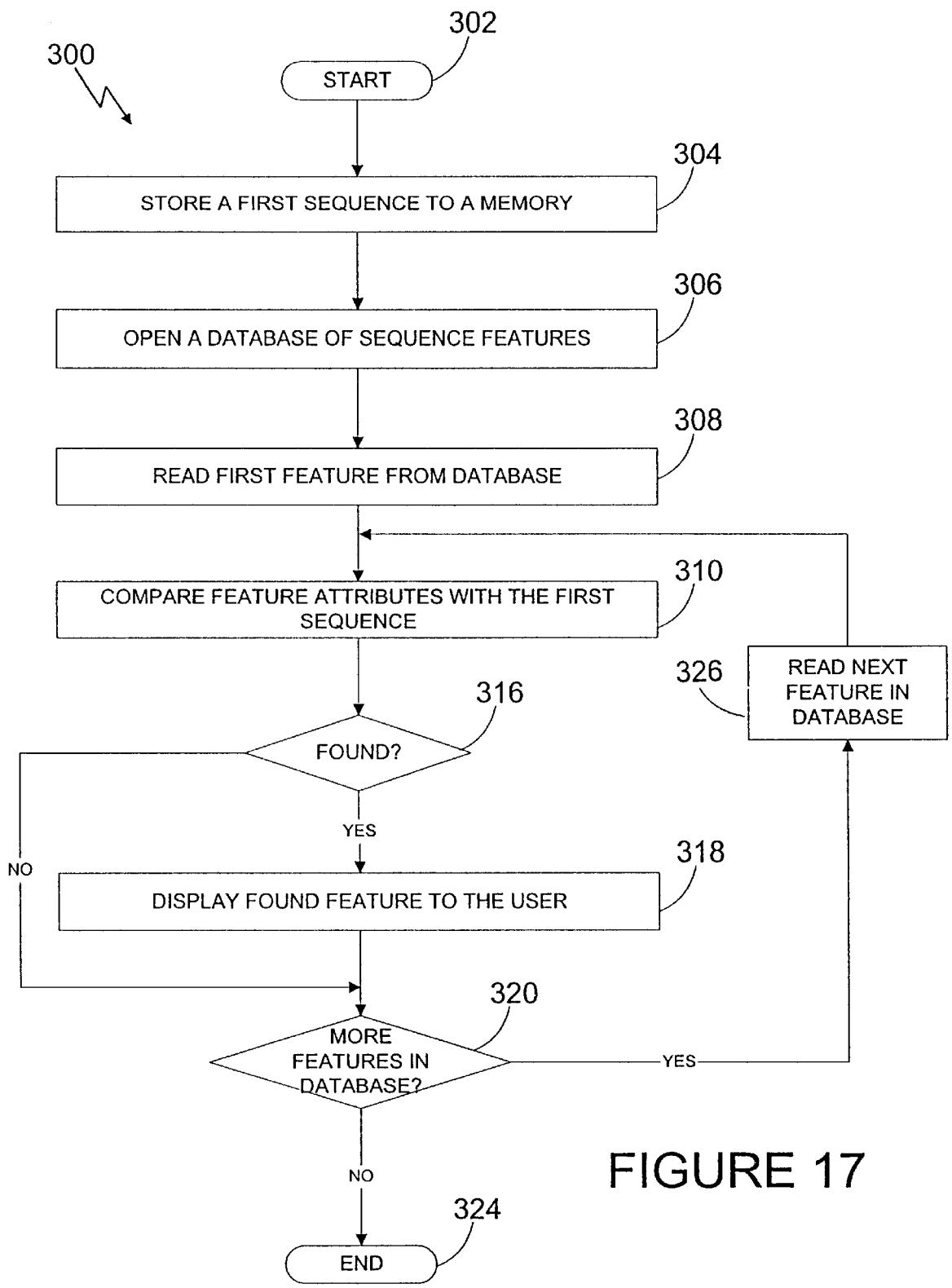
FIG. 17 is a flow diagram illustrating one embodiment of an identifier process 300 for detecting the presence of a feature in a sequence.

FIG. 17 is a flow diagram illustrating one embodiment of an identifier process 300 for detecting the presence of a feature in a sequence. The process 300 begins at a start state 302 and then moves to a state 304 wherein a first sequence that is to be checked for features is stored to a memory 115 in the computer system 100. The process 300 then moves to a state 306 wherein a database of sequence features is opened. Such a database would include a list of each feature's attributes along with the name of the feature. For example, a feature name could be "Initiation Codon" and the attribute would be "ATG". Another example would be the feature name "TAATAA Box" and the feature attribute would be "TAATAA". An example of such a database is produced by the University of Wisconsin Genetics Computer Group (www.gcg.com).

Once the database of features is opened at the state 306, the process 300 moves to a state 308 wherein the first feature is read from the database. A comparison of the attribute of the first feature with the first sequence is then made at a state 310. A determination is then made at a decision state 316 whether the attribute of the feature was found in the first sequence. If the attribute was found, then the process 300 moves to a state 318 wherein the name of the found feature is displayed to the user.

The process 300 then moves to a decision state 320 wherein a determination is made whether move features exist in the database. If no more features do exist, then the process 300 terminates at an end state 324. However, if more features do exist in the database, then the process 300 reads the next sequence feature at a state 326 and loops back to the state 310 wherein the attribute of the next feature is compared against the first sequence.

It should be noted, that if the feature attribute is not found in the first sequence at the decision state 316, the process 300 moves directly to the decision state 320 in order to determine if any more features exist in the database.

Accordingly, another aspect of the present invention is a method of identifying a feature within the nucleic acid codes of SEQ ID NOs. 1 to 3908, 1 to 2260, 2261 to 3374, 3735 to 3908, 3935 to 7842, 3935 to 6194, 6195 to 7668, 7669 to 7842, 7866 to 11773, 7866 to 10125, 10126 to 11599, and 11600 to 11773 comprising reading the nucleic acid code(s) through the use of a computer program which identifies features therein and identifying features within the nucleic acid code(s) with the computer program. In one embodiment, computer program comprises a computer program which identifies open reading frames. The method may be performed by reading a single sequence or at least 2, 5, 10, 15, 20, 25, 30, 50, 100, 200, 500, 1000, 2000, or 5000 of the nucleic acid codes of SEQ ID NOs. 1 to 3908, 1 to 2260, 2261 to 3374, 3735 to 3908, 3935 to 7842, 3935 to 6194, 6195 to 7668, 7669 to 7842, 7866 to 11773, 7866 to 10125, 10126 to 11599, and 11600 to 11773 through the use of the computer program and identifying features within the nucleic acid codes with the computer program.

The nucleic acid codes of SEQ ID NOs. 1 to 3908, 1 to 2260, 2261 to 3374, 3735 to 3908, 3935 to 7842, 3935 to 6194, 6195 to 7668, 7669 to 7842, 7866 to 11773, 7866 to 10125, 10126 to 11599, and 11600 to 11773 may be stored and manipulated in a variety of data processor programs in a variety of formats. For example, the nucleic acid codes of SEQ ID NOs. 1 to 3908, 1 to 2260, 2261 to 3374, 3735 to 3908, 3935 to 7842, 3935 to 6194, 6195 to 7668, 7669 to 7842, 7866 to 11773, 7866 to 10125, 10126 to 11599, and 11600 to 11773 may be stored as text in a word processing file, such as MicrosoftWORD or WORDPERFECT or as an ASCII file in a variety of database programs familiar to those of skill in the art, such as DB2, SYBASE, or ORACLE. In addition, many computer programs and databases may be used as sequence comparers, identifiers, or sources of reference nucleotide sequences to be compared to the nucleic acid codes of SEQ ID NOs. 1 to 3908, 1 to 2260, 2261 to 3374, 3735 to 3908, 3935 to 7842, 3935 to 6194, 6195 to 7668, 7669 to 7842, 7866 to 11773, 7866 to 10125, 10126 to 11599, and 11600 to 11773. The following list is intended not to limit the invention but to provide guidance to programs and databases which are useful with the nucleic acid codes of SEQ ID NOs. 1 to 3908, 1 to 2260, 2261 to 3374, 3735 to 3908, 3935 to 7842, 3935 to 6194, 6195 to 7668, 7669 to 7842, 7866 to 11773, 7866 to 10125, 10126 to 11599, and 11600 to 11773.

The programs and databases which may be used include, but are not limited to: MacPattern (EMBL), DiscoveryBase (Molecular Applications Group), GeneMine (Molecular Applications Group), Look (Molecular Applications Group), MacLook (Molecular Applications Group), BLAST and BLAST2 (NCBI), BLASTN and BLASTX (Altschul et al, *J. Mol. Biol.* 215: 403 (1990)), FASTA (Pearson and Lipman, *Proc. Natl. Acad. Sci. USA*, 85: 2444 (1988)), FASTDB (Brutlag et al. Comp. App. Biosci. 6:237–245, 1990), Catalyst (Molecular Simulations Inc.), Catalyst/SHAPE (Molecular Simulations Inc.), Cerius$^2$.DBAccess (Molecular Simulations Inc.), HypoGen (Molecular Simulations Inc.), Insight II, (Molecular Simulations Inc.), Discover (Molecular Simulations Inc.), CHARMm (Molecular Simulations Inc.), Felix (Molecular Simulations Inc.), DelPhi, (Molecular Simulations Inc.), QuanteMM, (Molecular Simulations Inc.), Homology (Molecular Simulations Inc.), Modeler (Molecular Simulations Inc.), ISIS (Molecular Simulations Inc.), Quanta/Protein Design (Molecular Simulations Inc.), WebLab (Molecular Simulations Inc.), WebLab Diversity Explorer (Molecular Simulations Inc.), Gene Explorer (Molecular Simulations Inc.), SeqFold (Molecular Simulations Inc.), the MDL Available Chemicals Directory database, the MDL Drug Data Report data base, the Comprehensive Medicinal Chemistry database, Derwents's World Drug Index database, the BioByteMasterFile database, the Genbank database, and the Genseqn database. Many other programs and data bases would be apparent to one of skill in the art given the present disclosure.

Motifs which may be detected using the above programs include sequences encoding leucine zippers, helix-turn-helix motifs, glycosylation sites, ubiquitination sites, alpha helices, and beta sheets, signal sequences encoding signal peptides which direct the secretion of the encoded proteins, sequences implicated in transcription regulation such as homeoboxes, acidic stretches, enzymatic active sites, substrate binding sites, and enzymatic cleavage sites.

It should be noted that the nucleic acid codes of the invention further encompass all of the polynucleotides disclosed, described or claimed in the present application. Moreover, the present invention specifically contemplates the storage of such codes on computer readable media and computer systems individually or in any combination, as well as the use of such codes and combinations in the methods of VI.

VII. Mapping and Maps Comprising the Biallelic Markers of the Invention

The human haploid genome contains an estimated 80,000 to 100,000 or more genes scattered on a $3\times10^9$ base-long double stranded DNA shared among the 24 chromosomes. Each human being is diploid, i.e. possesses two haploid genomes, one from paternal origin, the other from maternal origin. The sequence of the human genome varies among individuals in a population About $10^7$ sites scattered along the $3\times10^9$ base pairs of DNA are polymorphic, existing in at least two variant forms called alleles. Most of these polymorphic sites are generated by single base substitution mutations and are biallelic. Less than $10^5$ polymorphic sites are due to more complex changes and are very often multi-allelic, i.e. exist in more than two allelic forms. At a given polymorphic site, any individual (diploid), can be either homozygous (twice the same allele) or heterozygous (two different alleles). A given polymorphism or rare mutation can be either neutral (no effect on trait), or functional, i.e. responsible for a particular genetic trait.

Genetic Maps

The first step towards the identification of genes associated with a detectable trait, such as a disease or any other detectable trait, consists in the localization of genomic regions containing trait-causing genes using genetic mapping methods. The preferred traits contemplated within the present invention relate to fields of therapeutic interest; in particular embodiments, they will be disease traits and/or drug response traits, reflecting drug efficacy or toxicity. Traits can either be "binary", e.g. diabetic vs. non diabetic, or "quantitative", e.g. elevated blood pressure. Individuals affected by a quantitative trait can be classified according to an appropriate scale of trait values, e.g. blood pressure ranges. Each trait value range can then be analyzed as a binary trait. Patients showing a trait value within one such range will be studied in comparison with patients showing a trait value outside of this range. In such a case, genetic analysis methods will be applied to subpopulations of individuals showing trait values within defined ranges.

Genetic mapping involves the analysis of the segregation of polymorphic loci in trait positive and trait-negative populations. Polymorphic loci constitute a small fraction of the human genome (less than 1%), compared to the vast majority of human genomic DNA which is identical in sequence among the chromosomes of different individuals. Among all existing human polymorphic loci, genetic markers can be defined as genome-derived polynucleotides which are sufficiently polymorphic to allow a reasonable probability that a randomly selected person will be heterozygous, and thus informative for genetic analysis by methods such as linkage analysis or association studies.

A genetic map consists of a collection of polymorphic markers which have been positioned on the human chromosomes. Genetic maps may be combined with physical maps, collections of ordered overlapping fragments of genomic DNA whose arrangement along the human chromosomes is known. The optimal genetic map should possess the following characteristics:

the density of the genetic markers scattered along the genome should be sufficient to allow the identification and localization of any trait-related polymorphism, each marker should have an adequate level of heterozygosity, so as to be informative in a large percentage of different meioses, all markers should be easily typed on a routine basis, at a reasonable expense, and in a reasonable amount of time, the entire set of markers per chromosome should be ordered in a highly reliable fashion.

However, while the above maps are optimal, it will be appreciated that the maps of the present invention may be used in the individual marker and haplotype association analyses described below without the necessity of determining the order of biallelic markers derived from a single BAC with respect to one another.

Construction of a Physical Map

The first step in constructing a high density genetic map of biallelic markers is the construction of a physical map. Physical maps consist of ordered, overlapping cloned fragments of genomic DNA covering a portion of the genome, preferably covering one or all chromosomes. Obtaining a physical map of the genome entails constructing and ordering a genomic DNA library. For an example of a complete explanation of the construction of a physical map from a BAC library see related PCT Application No. PCT/IB98/00193 filed Jul. 17, 1998, the disclosure of which is incorporated herein by reference in its entirety. The methods disclosed therein can be used to generate larger more complete sets of markers and entire maps of the human genome comprising the map-relate biallelic markers of the invention.

Biallelic Markers

It will be appreciated that the ordered DNA fragments containing these groups of biallelic markers need not completely cover the genomic regions of these lengths but may instead be incomplete contigs having one or more gaps therein. As discussed in further detail below, biallelic markers may be used in single maker and haplotype association analyses regardless of the completeness of the corresponding physical contig harboring them.

Using the procedures above, 3908 biallelic markers, each having two alleles, were identified using sequences obtained from BACs which had been localized on the genome. In some cases, markers were identified using pooled BACs and thereafter reassigned to individual BACs using STS screening procedures such as those described in Examples 1 and 2. The sequences of these biallelic markers are provided in the accompanying Sequence Listing as SEQ ID Nos. 1 to 3908. Although the sequences of SEQ ID Nos. 1 to 3908 will be used as exemplary markers throughout the present application, these markers are not limited to markers having the exact flanking sequences surrounding the polymorphic bases which are enumerated in SEQ ID Nos. 1 to 3908. Rather, it will be appreciated that the flanking sequences surrounding the polymorphic bases of SEQ ID Nos. 1 to 3908 may be lengthened or shortened to any extent compatible with their intended use and the present invention specifically contemplates such sequences. The sequences of these biallelic markers may be used to construct genomic maps as well as in the gene identification and diagnostic techniques described herein. It will be appreciated that the biallelic markers referred to herein may be of any length compatible with their intended use provided that the markers include the polymorphic base, and the present invention specifically contemplates such sequences.

Some of the markers of SEQ ID Nos: 1 to 3908 as well as related amplification and microsequencing primers were disclosed in the instant priority documents. However, some of the earlier described amplification primers and microsequencing primers did not have the precise sequence lengths disclosed in the instant application. It will be appreciated that either length of primers may be used in the methods disclosed in the present application.

In addition, the internal identification numbers used to identify the biallelic markers disclosed in U.S. Provisional Patent Application Serial No. 60/082,614 filed Apr. 21, 1998 have been revised to include additional numbers on the end. For example, the marker formerly given the internal identification number 99-1091 was given the revised internal identification number 99-1091-446. Therefore, it will be appreciated that shortened identification numbers and extended identification numbers which overlap one another refer to the same markers.

Ordering of Biallelic Markers

Biallelic markers can be ordered to determine their positions along chromosomes, preferably subchromosomal regions, by methods known in the art as well as those disclosed in PCT Application No. PCT/IB98/00193 filed Jul. 17, 1998, and U.S. Provisional Patent Application Serial No. 60/082,614 filed Apr. 21, 1998.

The positions of the biallelic markers along chromosomes may be determined using a variety of methodologies. In one approach, radiation hybrid mapping is used. Radiation hybrid (RH) mapping is a somatic cell genetic approach that can be used for high resolution mapping of the human genome. In this approach, cell lines containing one or more human chromosomes are lethally irradiated, breaking each chromosome into fragments whose size depends on the radiation dose. These fragments are rescued by fusion with cultured rodent cells, yielding subclones containing different portions of the human genome. This technique is described by Benham et al. (*Genomics* 4:509–517, 1989) and Cox et al., (*Science* 250:245–250, 1990), the entire contents of which are hereby incorporated by reference. The random and independent nature of the subclones permits efficient mapping of any human genome marker. Human DNA isolated from a panel of 80–100 cell lines provides a mapping reagent for ordering biallelic markers. In this approach, the frequency of breakage between markers is used to measure distance, allowing construction of fine resolution maps as has been done for ESTs (Schuler et al., *Science* 274:540–546, 1996, hereby incorporated herein by reference in its entirety).

RH mapping has been used to generate a high-resolution whole genome radiation hybrid map of human chromosome 17q22-q25.3 across the genes for growth hormone (GH) and thymidine kinase (TK) (Foster et al., *Genomics* 33:185–192, 1996), the region surrounding the Gorlin syndrome gene (Obermayr et al., *Eur. J. Hum. Genet.* 4:242–245, 1996), 60 loci covering the entire short arm of chromosome 12 (Raeymaekers et al., *Genomics* 29:170–178, 1995), the region of human chromosome 22 containing the neurofibromatosis type 2 locus (Frazer et al., *Genomics* 14:574–584, 1992) and 13 loci on the long arm of chromosome 5 (Warrington et al., *Genomics* 11:701–708, 1991, the disclosure of which is hereby incorporated herein by reference in its entirety).

Alternatively, PCR based techniques and human-rodent somatic cell hybrids may be used to determine the positions of the biallelic markers on the chromosomes. In such approaches, oligonucleotide primer pairs which are capable of generating amplification products containing the polymorphic bases of the biallelic markers are designed. Preferably, the oligonucleotide primers are 18–23 bp in length and are designed for PCR amplification. The creation of PCR primers from known sequences is well known to those with skill in the art. For a review of PCR technology see Erlich, H. A., *PCR Technology: Principles and Applications for DNA Amplification*. 1992. W. H. Freeman and Co., New York, the disclosure of which is hereby incorporated herein by reference in its entirety.

The primers are used in polymerase chain reactions (PCR) to amplify templates from total human genomic DNA. PCR conditions are as follows: 60 ng of genomic DNA is used as a template for PCR with 80 ng of each oligonucleotide primer, 0.6 unit of Taq polymerase, and 1 mCu of a $^{32}$P-labeled deoxycytidine triphosphate. The PCR is performed in a microplate thermocycler (Techne) under the following conditions: 30 cycles of 94° C., 1.4 min; 55° C., 2 min; and 72° C., 2 min; with a final extension at 72° C. for 10 min. The amplified products are analyzed on a 6% polyacrylamide sequencing gel and visualized by autoradiography. If the length of the resulting PCR product is identical to the length expected for an amplification product containing the polymorphic base of the biallelic marker, then the PCR reaction is repeated with DNA templates from two panels of human-rodent somatic cell hybrids, BIOS PCRable DNA (BIOS Corporation) and NIGMS Human-Rodent Somatic Cell Hybrid Mapping Panel Number 1 (NIGMS, Camden, N.J.).

PCR is used to screen a series of somatic cell hybrid cell lines containing defined sets of human chromosomes for the presence of a given biallelic marker. DNA is isolated from the somatic hybrids and used as starting templates for PCR reactions using the primer pairs from the biallelic marker. Only those somatic cell hybrids with chromosomes containing the human sequence corresponding to the biallelic marker will yield an amplified fragment. The biallelic markers are assigned to a chromosome by analysis of the segregation pattern of PCR products from the somatic hybrid DNA templates. The single human chromosome present in all cell hybrids that give rise to an amplified fragment is the chromosome containing that biallelic marker. For a review of techniques and analysis of results from somatic cell gene mapping experiments. (See Ledbetter et al., *Genomics* 6:475–481 (1990 the disclosure of which is incorporated herein by reference in its entirety).)

Example 2 describes a preferred method for positioning of biallelic markers on clones, such as BAC clones, obtained from genomic DNA libraries. Using such procedures, a number of BAC clones carrying selected biallelic markers can be isolated. The position of these BAC clones on the human genome can be defined by performing STS screening as described in Example 1. Preferably, to decrease the number of STSs to be tested, each BAC can be localized on chromosomal or subchromosomal regions by procedures such as those described in Examples 3 and 4. This localization will allow the selection of a subset of STSs corresponding to the identified chromosomal or subchromosomal region. Testing each BAC with such a subset of STSs and taking account of the position and order of the STSs along the genome will allow a refined positioning of the corresponding biallelic marker along the genome.

In other embodiments, if the DNA library used to isolate BAC inserts or any type of genomic DNA fragments harboring the selected biallelic markers already constitute a physical map of the genome or any portion thereof, using the known order of the DNA fragments will allow the order of the biallelic markers to be established.

As discussed above, it will be appreciated that markers carried by the same fragment of genomic DNA, such as the insert in a BAC clone, need not necessarily be ordered with respect to one another within the genomic fragment to conduct single point or haplotype association analyses. However, in other embodiments of the present maps, the order of biallelic markers carried by the same fragment of genomic DNA may be determined.

The positions of the biallelic markers used to construct the maps of the present invention, including the map-related biallelic markers of the invention, may be assigned to subchromosomal locations using Fluorescence In Situ Hybridization (FISH) (Cherif et al., *Proc. Natl. Acad. Sci. U.S.A.*, 87:6639–6643 (1990), the disclosure of which is incorporated herein by reference in its entirety). FISH analysis is described in Example 3.

The ordering analyses may be conducted to generate an integrated genome wide genetic map comprising about 20,000, 40,000, 60,000, 80,000, 100,000, 120,000 biallelic markers with a roughly consistent number of biallelic marker per BAC. In some embodiments, the map includes one or more markers selected from the group consisting of the sequences of SEQ ID Nos. 1 to 3908, 1 to 2260, 2261 to 3374, 3735 to 3908 or the sequences complementary thereto.

Alternatively, maps having the above-specified average numbers of biallelic markers per BAC which comprise smaller portions of the genome, such as a set of chromosomes, a single chromosome, a particular subchromosomal region, or any other desired portion of the genome, may also be constructed using the procedures provided herein.

In some embodiments, the biallelic markers in the map are separated from one another by an average distance of 10–200 kb, 15–150 kb, 20–100 kb, 100–150 kb, 50–100 kb, or 25–50 kb. Maps having the above-specified intermarker distances which comprise smaller portions of the genome, such as a set of chromosomes, a single chromosome, a particular subchromosomal region, or any other desired portion of the genome, may also be constructed using the procedures provided herein.

FIG. 2, showing the results of computer simulations of the distribution of inter-marker spacing on a randomly distributed set of biallelic markers, indicates the percentage of biallelic markers which will be spaced a given distance apart for a given number of markers/BAC in the genomic map (assuming 20,000 BACs constituting a minimally overlapping array covering the entire genome are evaluated). One hundred iterations were performed for each simulation (20,000 marker map, 40,000 marker map, 60,000 marker map, 120,000 marker map).

Figure 2A:
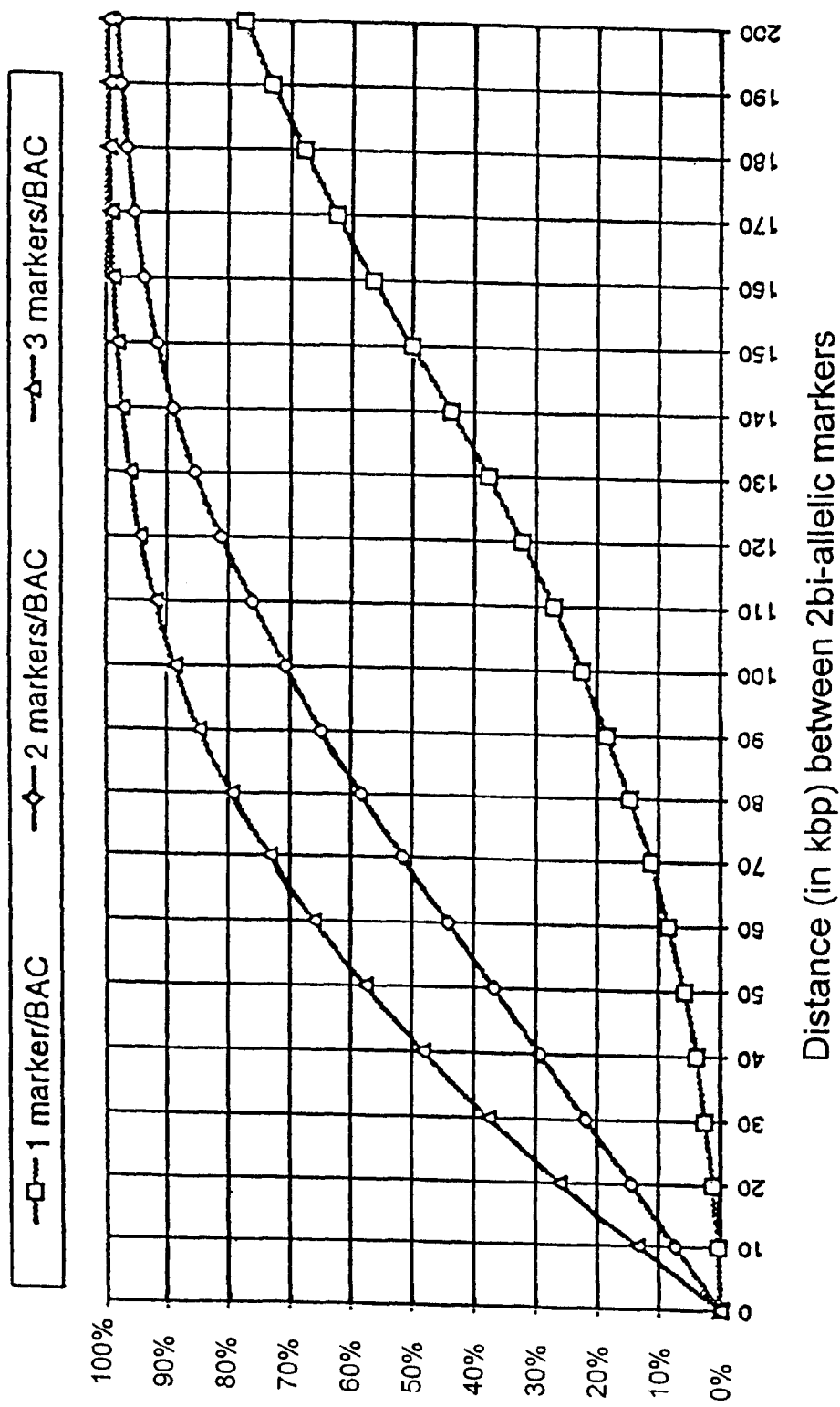
FIG. 2a shows the results of a computer simulation of the distribution of inter-marker spacing on a randomly distributed set of biallelic markers indicating the percentage of biallelic markers which will be spaced a given distance apart for 1, 2, or 3 markers/BAC in a genomic map (assuming a set of 20,000 minimally overlapping BACs covering the genome are evaluated).

As illustrated in FIG. 2a, 98% of inter-marker distances will be lower than 150 kb provided 60,000 evenly distributed markers are generated (3 per BAC); 90% of inter-marker distances will be lower than 150 kb provided 40,000 evenly distributed markers are generated (2 per BAC); and 50% of inter-marker distances will be lower than 150 kb provided 20,000 evenly distributed markers are generated (1 per BAC).

Figure 2B:
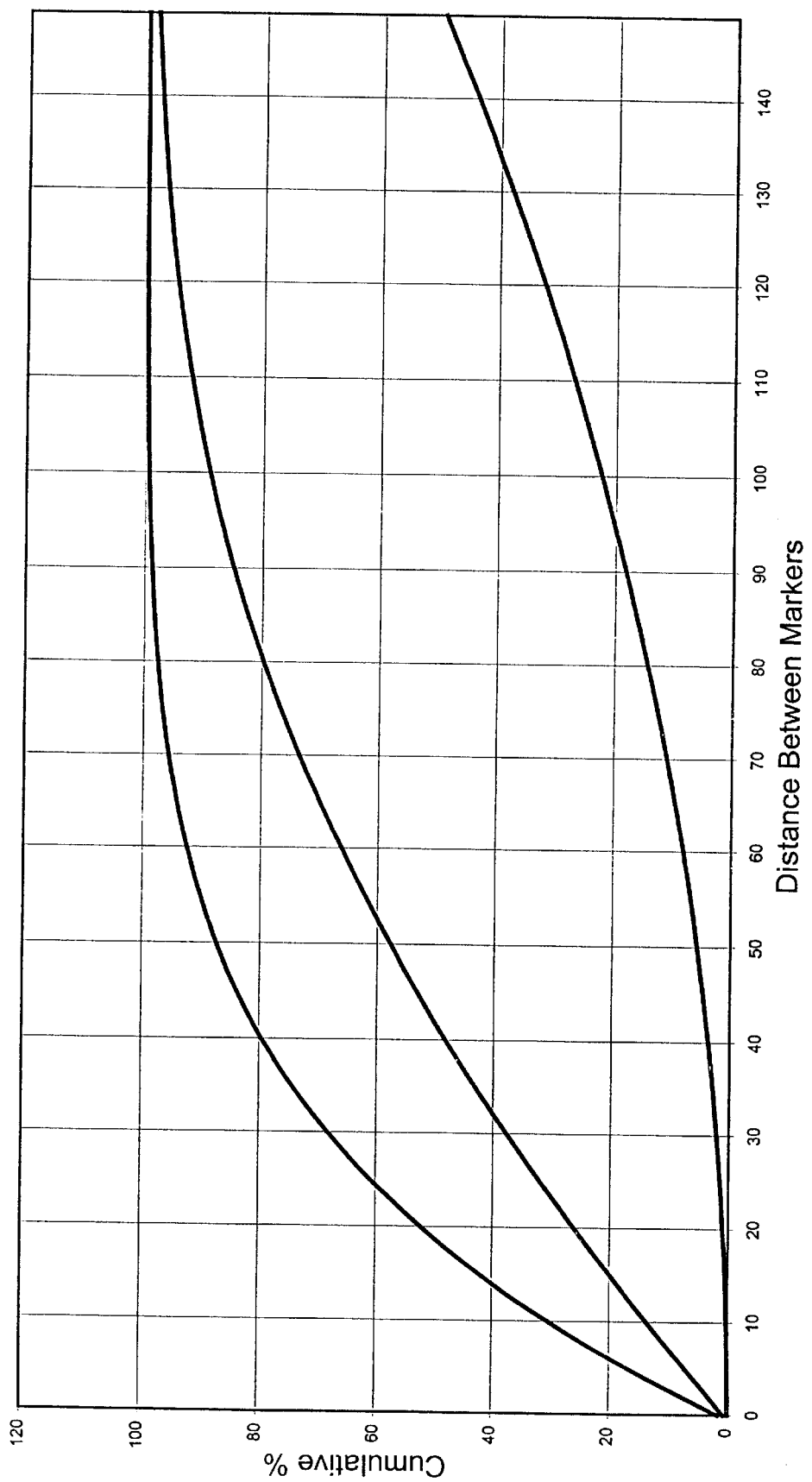
FIG. 2b shows the results of a computer simulation of the distribution of inter-marker spacing on a randomly distributed set of biallelic markers indicating the percentage of biallelic markers which will be spaced a given distance apart for 1, 3, or 6 markers/BAC in a genomic map (assuming a set of 20,000 minimally overlapping BACs covering the genome are evaluated).

As illustrated in FIG. 2b, 98% of inter-marker distances will be lower than 80 kb provided 120,000 evenly distributed markers are generated (6 per BAC); 80% of inter-marker distances will be lower than 80 kb provided 60,000 evenly distributed markers are generated (3 per BAC); and 15% of inter-marker distances will be lower than 80 kb provided 20,000 evenly distributed markers are generated (1 per BAC).

As already mentioned, high density biallelic marker maps allow association studies to be performed to identify genes involved in complex traits.

Tables 9 to 11 provide the genomic location of biallelic markers described herein. Listed are chromosomal regions and subregions to which biallelic markers were assigned using the methods of Example 3 and by screening BAC sequences against published and unpublished STSs.

In particular, the locations of markers listed in table 9 are locations for which adjacent STSs are publicly available. The column "adjacent STS" provides the public accession numbers of STSs localised on the same BAC with the subject biallelic marker as well as aliases for said STSs. As noted above, all of the marker localisations provided in Table 9 are confirmed by fluorescence in situ hybridization methods and public STS screening.

Table 10 describes chromosomal locations for biallelic markers for which no public adjacent STSs were available. Thus, Table 10 provides biallelic markers for which chromosomal localisations obtained by methods of FISH were confirmed by unpublished STSs, localisations which were obtained only by FISH, and localisations obtained by FISH which were discordant with localisations obtained from unpublished STSs.

Biallelic markers for which localisation were unconfirmed due to discordant localisation from STS screening and FISH methods are further provided in Table 11. The 204, 205, 225, 273, 274, 1723, 1732, 1743 localisations of these biallelic markers listed in Table 11 are those obtained by FISH methods, and may thus be considered as potential localisations. Table 11 includes certain markers also listed in Table 10.

Linkage Disequilibrium

The present invention then also concerns biallelic markers in linkage disequilibrium with the specific biallelic markers described above and which are expected to present similar characteristics in terms of their respective association with a given trait. In a preferred embodiment, the present invention concerns the biallelic markers that are in linkage disequilibrium with the biallelic markers of SEQ ID Nos. 1 to 3908, 1 to 2260, 2261 to 3374, 3735 to 3908 or the sequences complementary thereto.

LD among a set of biallelic markers having an adequate heterozygosity rate can be determined by genotyping between 50 and 1000 unrelated individuals, preferably between 75 and 200, more preferably around 100. Genotyping a biallelic marker consists of determining the specific allele carried by an individual at the given polymorphic base of the biallelic marker. Genotyping can be performed using similar methods as those described above for the generation of the biallelic markers, or using other genotyping methods such as those further described below.

Genome-wide linkage disequilibrium mapping aims at identifying, for any trait-causing allele being searched, at least one biallelic marker in linkage disequilibrium with said trait-causing allele. Preferably, in order to enhance the power of linkage disequilibrium maps, in some embodiments, the biallelic markers therein have average inter-marker distances of 150 kb or less, 75 kb or less, or 50 kb or less, 30 kb or less, or 25 kb or less to accommodate the fact that, in some regions of the genome, the detection of linkage disequilibrium requires lower inter-marker distances.

The present invention provides methods to generate biallelic marker maps with average inter-marker distances of 150 kb or less. In some embodiments, the mean distance between biallelic markers constituting the high density map will be less than 75 kb, preferably less than 50 kb. Further preferred maps according to the present invention contain markers that are less than 37.5 kb apart. In highly preferred embodiments, the average inter-marker spacing for the biallelic markers constituting very high density maps is less than 30 kb, most preferably less than 25 kb.

Genetic maps containing biallelic markers (including the biallelic markers of SEQ ID Nos. 1 to 3908, 1 to 2260, 2261 to 3374, 3735 to 3908 or the sequences complementary thereto) may be used to identify and isolate genes associated with detectable traits. The use of the genetic maps of the present invention is described in more detail below.

VIII. Use of High Density Biallelic Marker Maps to Identify Genes Associated with Detectable Traits One embodiment of the present invention comprises methods for identifying and isolating genes associated with a detectable trait using the biallelic marker maps of the present invention.

In the past, the identification of genes linked with detectable traits has relied on a statistical approach called linkage analysis. Linkage analysis is based upon establishing a correlation between the transmission of genetic markers and that of a specific trait throughout generations within a family. In this approach, all members of a series of affected families are genotyped with a few hundred markers, typically microsatellite markers, which are distributed at an average density of one every 10 Mb. By comparing genotypes in all family members, one can attribute sets of alleles to parental haploid genomes (haplotyping or phase determination). The origin of recombined fragments is then determined in the offsping of all families. Those that co-segregate with the trait are tracked. After pooling data from all families, statistical methods are used to determine the likelihood that the marker and the trait are segregating independently in all families. As a result of the statistical analysis, one or several regions having a high probability of harboring a gene linked to the trait are selected as candidates for further analysis. The result of linkage analysis is considered as significant (i.e. there is a high probability that the region contains a gene involved in a detectable trait) when the chance of independent segregation of the marker and the trait is lower than 1 in 1000 (expressed as a LOD score>3). Generally, the length of the candidate region identified using linkage analysis is between 2 and 20 Mb.

Once a candidate region is identified as described above, analysis of recombinant individuals using additional markers allows further delineation of the candidate linked region.

Linkage analysis studies have generally relied on the use of a maximum of 5,000 microsatellite markers, thus limiting the maximum theoretical attainable resolution of linkage analysis to ca. 600 kb on average.

Linkage analysis has been successfully applied to map simple genetic traits that show clear Mendelian inheritance patterns and which have a high penetrance (penetrance is the ratio between the number of trait-positive carriers of allele a and the total number of a carriers in the population). About 100 pathological trait-causing genes were discovered using linkage analysis over the last 10 years. In most of these cases, the majority of affected individuals had affected relatives and the detectable trait was rare in the general population (frequencies less than 0.1%). In about 10 cases, such as Alzheimer's Disease, breast cancer, and Type II diabetes, the detectable trait was more common but the allele associated with the detectable trait was rare in the affected population. Thus, the alleles associated with these traits were not responsible for the trait in all sporadic cases.

Linkage analysis suffers from a variety of drawbacks. First, linkage analysis is limited by its reliance on the choice of a genetic model suitable for each studied trait. Furthermore, as already mentioned, the resolution attainable using linkage analysis is limited, and complementary studies are required to refine the analysis of the typical 2 Mb to 20 Mb regions initially identified through linkage analysis.

In addition, linkage analysis approaches have proven difficult when applied to complex genetic traits, such as those due to the combined action of multiple genes and/or environmental factors. In such cases, too large an effort and cost are needed to recruit the adequate number of affected families required for applying linkage analysis to these situations, as recently discussed by Risch, N. and Merikangas, K. (*Science* 273:1516–1517 (1996), the disclosure of which is incorporated herein by reference in its entirety).

Finally, linkage analysis cannot be applied to the study of traits for which no large informative families are available. Typically, this will be the case in any attempt to identify trait-causing alleles involved in sporadic cases, such as alleles associated with positive or negative responses to drug treatment.

The present genetic maps and biallelic markers (including the biallelic markers of SEQ ID Nos. 1 to 3908, 1 to 2260, 2261 to 3374, 3735 to 3908 or the sequences complementary thereto) may be used to identify and isolate genes associated with detectable traits using association studies, an approach which does not require the use of affected families and which permits the identification of genes associated with sporadic traits.

Association Studies

As already mentioned, any gene responsible or partly responsible for a given trait will be in linkage disequilibrium with some flanking markers. To map such a gene, specific alleles of these flanking markers which are associated with the gene or genes responsible for the trait are identified. Although the following discussion of techniques for finding the gene or genes associated with a particular trait using linkage disequilibrium mapping, refers to locating a single gene which is responsible for the trait, it will be appreciated that the same techniques may also be used to identify genes which are partially responsible for the trait.

Association studies may be conducted within the general population (as opposed to the linkage analysis techniques discussed above which are limited to studies performed on related individuals in one or several affected families).

Association between a biallelic marker A and a trait T may primarily occur as a result of three possible relationships between the biallelic marker and the trait.

First, allele a of biallelic marker A may be directly responsible for trait T (e.g., Apo E ε 4 site A and Alzheimer's disease). However, since the majority of the biallelic markers used in genetic mapping studies are selected randomly, they mainly map outside of genes. Thus, the likelihood of allele a being a functional mutation directly related to trait T is very low.

Second, an association between a biallelic marker A and a trait T may also occur when the biallelic marker is very closely linked to the trait locus. In other words, an association occurs when allele a is in linkage disequilibrium with the trait-causing allele. When the biallelic marker is in close proximity to a gene responsible for the trait, more extensive genetic mapping will ultimately allow a gene to be discovered near the marker locus which carries mutations in people with trait T (i.e. the gene responsible for the trait or one of the genes responsible for the trait). As will be further exemplified below, using a group of biallelic markers which are in close proximity to the gene responsible for the trait the location of the causal gene can be deduced from the profile of the association curve between the biallelic markers and the trait. The causal gene will usually be found in the vicinity of the marker showing the highest association with the trait.

Finally, an association between a biallelic marker and a trait may occur when people with the trait and people without the trait correspond to genetically different subsets of the population who, coincidentally, also differ in the frequency of allele a (population stratification). This phenomenon may be avoided by using ethnically matched large heterogeneous samples.

Association studies are particularly suited to the efficient identification of genes that present common polymorphisms, and are involved in multifactorial traits whose frequency is relatively higher than that of diseases with monofactorial inheritance.

Association studies mainly consist of four steps: recruitment of trait-positive (T+) and control populations, preferably trait-negative (T−) populations with well-defined phenotypes, identification of a candidate region suspected of harboring a trait causing gene, identification of said gene among candidate genes in the region, and finally validation of mutation(s) responsible for the trait in said trait causing gene.

In a first step, the trait-positive should be well-defined, preferably the control phenotype is a well-defined trait-negative phenotype as well. In order to perform efficient and significant association studies such as those described herein, the trait under study should preferably follow a bimodal distribution in the population under study, presenting two clear non-overlapping phenotypes, trait-positive and trait-negative.

Nevertheless, in the absence of such a bimodal distribution (as may in fact be the case for complex genetic traits), any genetic trait may still be analyzed using the association method proposed herein by carefully selecting the individuals to be included in the trait-positive group and preferably the trait-negative phenotypic group as well. The selection procedure ideally involves selecting individuals at opposite ends of the non-bimodal phenotype spectrum of the trait under study, so as to include in these trait-positive and trait-negative populations individuals who clearly represent non-overlapping, preferably extreme phenotypes.

As discussed above, the definition of the inclusion criteria for the trait-positive and control populations is an important aspect of the present invention.

FIG. 3 shows, for a series of hypothetical sample sizes, the p-value significance obtained in association studies performed using individual markers from the high-density biallelic map, according to various hypotheses regarding the difference of allelic frequencies between the trait-positive and trait-negative samples. It indicates that, in all cases, samples ranging from 150 to 500 individuals are numerous enough to achieve statistical significance. It will be appreciated that bigger or smaller groups can be used to perform association studies according to the methods of the present invention.

In a second step, a marker/trait association study is performed that compares the genotype frequency of each biallelic marker in the above described trait-positive and trait-negative populations by means of a chi square statistical test (one degree of freedom). In addition to this single marker association analysis, a haplotype association analysis is performed to define the frequency and the type of the ancestral carrier haplotype. Haplotype analysis, by combining the informativeness of a set of biallelic markers increases the power of the association analysis, allowing false positive and/or negative data that may result from the single marker studies to be eliminated.

Genotyping can be performed using any method described in III, including the microsequencing procedure described in Example 8.

If a positive association with a trait is identified using an array of biallelic markers having a high enough density, the causal gene will be physically located in the vicinity of the associated markers, since the markers showing positive association with the trait are in linkage disequilibrium with the trait locus. Regions harboring a gene responsible for a particular trait which are identified through association studies using high density sets of biallelic markers will, on average, be 20–40 times shorter in length than those identified by linkage analysis.

Once a positive association is confirmed as described above, a third step consists of completely sequencing the BAC inserts harboring the markers identified in the association analyzes. These BACs are obtained through screening human genomic libraries with the markers probes and/or primers, as described above. Once a candidate region has been sequenced and analyzed, the functional sequences within the candidate region (e.g. exons, splice sites, promoters, and other potential regulatory regions) are scanned for mutations which are responsible for the trait by comparing the sequences of the functional regions in a selected number of trait-positive and trait-negative individuals using appropriate software. Tools for sequence analysis are further described in Example 9.

Finally, candidate mutations are then validated by screening a larger population of trait-positive and trait-negative individuals using genotyping techniques described below. Polymorphisms are confirmed as candidate mutations when the validation population shows association results compatible with those found between the mutation and the trait in the test population.

In practice, in order to define a region bearing a candidate gene, the trait-positive and trait-negative populations are genotyped using an appropriate number of biallelic markers. The markers may include one or more of the markers of SEQ ID Nos: 1 to 3908, 1 to 2260, 2261 to 3374, 3735 to 3908 or the sequences complementary thereto.

The markers used to define a region bearing a candidate gene may be distributed at an average density of 1 marker per 10–200 kb. Preferably, the markers used to define a region bearing a candidate gene are distributed at an average density of 1 marker every 15–150 kb. In further preferred embodiments, the markers used to define a region bearing a candidate gene are distributed at an average density of 1 marker every 20–100 kb. In yet another preferred embodiment, the markers used to define a region bearing a candidate gene are distributed at an average density of 1 marker every 100 to 150 kb. In a further highly preferred embodiment, the markers used to define a region bearing a candidate gene are distributed at an average density of 1 marker every 50 to 100 kb. In yet another embodiment, the biallelic markers used to define a region bearing a candidate gene are distributed at an average density of 1 marker every 25–50 kilobases. As mentioned above, in order to enhance the power of linkage disequilibrium based maps, in a preferred embodiment, the marker density of the map will be adapted to take the linkage disequilibrium distribution in the genomic region of interest into account.

In some embodiments, the initial identification of a candidate genomic region harboring a gene associated with a detectable phenotype may be conducted using a preliminary map containing a few thousand biallelic markers. Thereafter, the genomic region harboring the gene responsible for the detectable trait may be better delineated using a map containing a larger number of biallelic markers. Furthermore, the genomic region harboring the gene responsible for the detectable trait may be further delineated using a high density map of biallelic markers. Finally, the gene associated with the detectable trait may be identified and isolated using a very high density biallelic marker map.

Example 6 describes a procedure for identifying a candidate region harboring a gene associated with a detectable trait and provides simulated results for this procedure. It will be appreciated that although Example 6 compares the results of simulated analyzes using markers derived from maps having 3,000, 20,000, and 60,000 markers, the number of markers contained in the map is not restricted to these exemplary figures. Rather, Example 6 exemplifies the increasing refinement of the candidate region with increasing marker density. As increasing numbers of markers are used in the analysis, points in the association analysis become broad peaks. The gene associated with the detectable trait under investigation will lie within or near the region under the peak.

The statistical power of linkage disequilibrium mapping using a high density marker map is also reinforced by complementing the single point association analysis described above with a multi-marker association analysis of haplotype analysis described in IV. To improve the statistical power of the individual marker association analyses conducted as described above using maps of increasing marker densities, haplotype studies can be performed using groups of markers located in proximity to one another within regions of the genome. For example, using the methods described above in which the association of an individual marker with a detectable phenotype was analyzed using maps of 3,000 markers, 20,000 markers, and 60,000 markers, a series of haplotype studies can be performed using groups of contiguous markers from such maps or from maps having higher marker densities.

In a preferred embodiment, a series of successive haplotype studies including groups of markers spanning regions of more than 1 Mb may be performed. In some embodiments, the biallelic markers included in each of these groups may be located within a genomic region spanning less than 1 kb, from 1 to 5 kb, from 5 to 10 kb, from 10 to 25 kb, from 25 to 50 kb, from 50 to 150 kb, from 150 to 250 kb, from 250 to 500 kb, from 500 kb to 1 Mb, or more than 1 Mb. Preferably, the genomic regions containing the groups of biallelic markers used in the successive haplotype analyses are overlapping. It will be appreciated that the groups of biallelic markers need not completely cover the genomic regions of the above-specified lengths but may instead be obtained from incomplete contigs having one or more gaps therein. As discussed in further detail below, biallelic markers may be used in single point and haplotype association analyses regardless of the completeness of the corresponding physical contig harboring them.

Genome-wide mapping using association studies with dense enough arrays of markers permit a case-by-case best estimate of p-value significance thresholds. Given a test population comprising two ethnically matched trait-positive and control groups of about 50 to about 500 individuals or more, conducting the above described association studies will allow a p-value "cut-off" to be established by, for example, analyzing significant numbers of allele frequency differences or, in some cases where appropriate, running computer simulations or control studies as described in Examples 6, 15, and 26.

For a p-value above the threshold, a corresponding association between the trait and a studied marker will be deemed not significant, while for a p-value below such a threshold, said association will be deemed significant. If the p-value is significant, the genomic region around the marker will be further scrutinized for a trait-causing gene.

It is preferred that p-value significance thresholds be assessed for each case/control population comparison. Both the genetic distance between sampled population—"stratification"—and the dispersion due to random selection of samples may indeed influence the p-value significance thresholds.

It will be appreciated that the above approaches may be conducted on any scale (i.e. over the whole genome, a set of chromosomes, a single chromosome, a particular subchromosomal region, or any other desired portion of the genome). As mentioned above, once significance thresholds have been assessed, population sample sizes may be adapted as exemplified in FIG. 3.

Example 7 below illustrates the increase in statistical power brought to an association study by a haplotype analysis.

The results described in Examples 5 and 7, generated from individual and haplotype studies using a biallelic marker set of an average density equal to ca. 40 kb in the region of an Alzheimer's disease trait causing gene, indicate that all biallelic markers of sufficient informative content located within a ca. 200 kb genomic region around a trait-causing allele can potentially be successfully used to localize a trait causing gene with the methods provided by the present invention. This conclusion is further supported by the results obtained through measuring the linkage disequilibrium between markers 99-365-344 or 99-359-308 and ApoE 4 Site A marker within Alzheimer's patients: as one could predict since linkage disequilibrium is the supporting basis for association studies, linkage disequilibrium between these pairs of markers was enhanced in the diseased population vs. the control population. In a similar way as the haplotype analysis enhanced the significance of the corresponding association studies.

Once a given polymorphic site has been found and characterized as a biallelic marker according to the methods of the present invention, several methods can be used in order to determine the specific allele carried by an individual at the given polymorphic base as described in III.

Location of a Gene Associated with Detectable Traits

Once the candidate region has been delineated using the high density biallelic marker map, a sequence analysis process will allow the detection of all genes located within said region, together with a potential functional characterization of said genes. The identified functional features may allow preferred trait-causing candidates to be chosen from among the identified genes. More biallelic markers may then be generated within said candidate genes, and used to perform refined association studies that will support the identification of the trait causing gene. Sequence analysis processes are described in Example 9.

Examples 10–18 illustrate the application of the above methods using biallelic markers to identify a gene associated with a complex disease, prostate cancer, within a ca. 450 kb candidate region. Additional details of the identification of the gene associated with prostate cancer are provided in the U.S. patent application entitled "Prostate Cancer Gene" Ser. No. 08/996,306, the disclosure of which is incorporated herein by reference in its entirety.

The above methods were also used to identify biallelic markers in a gene which was an attractive candidate for a gene associated with asthma. Examples 19–26 show how the use of methods of the present invention allowed this gene to be identified as a gene responsible, at least partially, for asthma in the studied populations. Additional details of the identification of the gene associated with asthma are provided in U.S. Provisional Application Serial Nos. 60/081, 893, the disclosure of which are incorporated herein by reference in its entirety Alternatively, genes associated with detectable traits may be identified as follows. Candidate genomic regions suspected of harboring a gene associated with the trait may be identified using techniques such as those described herein. In such techniques, the allelic frequencies of biallelic markers are compared in nucleic acid samples derived from individuals expressing the detectable trait and individuals who do not express the detectable trait. In this manner, candidate genomic regions suspected of harboring a gene associated with the detectable trait under investigation are identified.

The existence of one or more genes associated with the detectable trait within the candidate region is confirmed by identifying more biallelic markers lying in the candidate region. A first haplotype analysis is performed for each possible combination of groups of biallelic markers within the genomic region suspected of harboring a trait-associated gene. For % example, each group may comprise three biallelic markers. For each of the groups of markers, the frequency of each possible haplotype (for groups of three markers there are 8 possible haplotypes) in individuals expressing the trait and individuals who do not express the trait is estimated. For example, the a haplotype estimation method is applied as described in IV. for example the haplotype frequencies may be estimated using the Expectation-Maximization method of Excoffier L and Slatkin M, *Mol. Biol. Evol.* 12:921–927 (1995), the disclosure of which is incorporated herein by reference in its entirety.

The frequencies of each of the possible haplotypes of the grouped markers (or each allele of individual markers) in individuals expressing the trait and individuals who do not express the trait are compared. For example, the frequencies may be compared by performing a chi-squared analysis. Within each group, the haplotype (or the allele of each individual marker) having the greatest association with the trait is selected. This process is repeated for each group of biallelic markers (or each allele of the individual markers) to generate a distribution of association values, which will be referred to herein as the "trait-associated" distribution.

A second haplotype analysis is performed for each possible combination of groups of biallelic markers within the genomic regions which are not suspected of harboring a trait-associated gene. For example, each group may comprise three biallelic markers. For each of the groups of markers, the frequency of each possible haplotype (for groups of three markers there are 8 possible haplotypes) in individuals expressing the trait and individuals who do not express the trait is estimated.

The frequencies of each of the possible haplotypes of the grouped markers (or each allele of individual markers) in individuals expressing the trait and individuals who do not express the trait are compared. For example, the frequencies may be compared by performing a chi-squared analysis. Within each group, the haplotype (or the allele of each individual marker) having the greatest association with the trait is selected. This process is repeated for each group of biallelic markers (or each allele of the individual markers) to generate a distribution of association values, which will be referred to herein as the "random" distribution.

The trait-associated distribution and the random distribution are then compared to one another to determine if there are significant differences between them. For example, the trait-associated distribution and the random distribution can be compared using either the Wilcoxon rank test (Noether, G. E. (1991) Introduction to statistics: "The nonparametric way", Springer-Verlag, New York, Berlin, the disclosure of which is incorporated herein by reference in its entirety) or the Kolmogorov-Smirnov test (Saporta, G. (1990) "Probalites, analyse des donnees et statistiques" Technip editions, Paris, the disclosure of which is incorporated herein by reference in its entirety) or both the Wilcoxon rank test and the Kolmogorov-Smirnov test.

If the trait-associated distribution and the random distribution are found to be significantly different, the candidate genomic region is highly likely to contain a gene associated with the detectable trait. Accordingly, the candidate genomic region is evaluated more fully to isolate the trait-associated gene. Alternatively, if the trait-associated distribution and the random distribution are equal using the above analyses, the candidate genomic region is unlikely to contain a gene associated with the detectable trait. Accordingly, no further analysis of the candidate genomic region is performed.

While Examples 10 to 26 illustrate the use of the maps and markers of the present invention for identifying a new gene associated with a complex disease within a 2 Mb genomic region for establishing that a candidate gene is, at least partially, responsible for a disease, the maps and markers of the present invention may also be used to identify one or more biallelic markers or one or more genes associated with other detectable phenotypes, including drug response, drug toxicity, or drug efficacy. The biallelic markers used in such drug response analyses or shown, using the methods of the present invention to be associated with such traits, may lie within or near genes responsible for or partly responsible for a particular disease, for example a disease against which the drug is meant to act, or may lie within genomic regions which are not responsible for or partly responsible for a disease. In the context of the present invention, a "positive response" to a medicament can be defined as comprising a reduction of the symptoms related to the disease or condition to be treated. In the context of the present invention, a "negative response" to a medicament can be defined as comprising either a lack of positive response to the medicament which does not lead to a symptom reduction or to a side-effect observed following administration of the medicament.

Drug efficacy, response and tolerance/toxicity can be considered as multifactorial traits involving a genetic component in the same way as complex diseases such as Alzheimer's disease, prostate cancer, hypertension or diabetes. As such, the identification of genes involved in drug efficacy and toxicity could be achieved following a positional cloning approach, e.g. performing linkage analysis within families in order to obtain the subchromosomal location of the gene(s). However, this type of analysis is actually impractical in the case of drug responsiveness, due to the lack of availability of familial cases. In fact, the likelihood of having more than one individual in a particular family being exposed to the same drug at the same time is very low. Therefore, drug efficacy and toxicity can only be analyzed as sporadic traits.

In order to conduct association studies to analyze the individual response to a given drug in groups of patients affected with a disease, up to four groups are screened to determine their patterns of biallelic markers using the techniques described above. The four groups are:

Non-diseased or random controls,

Diseased patients/drug responders,

Diseased patients/drug non-responders, and

Diseased patients/drug side effects.

In preferred embodiments, the above mentioned groups are recruited according to phenotyping criteria having the characteristics described above, so that the phenotypes defining the different groups are non-overlapping, preferably extreme phenotypes. In highly preferred embodiments, such phenotyping criteria have the bimodal distribution described above.

The final number and composition of the groups for each drug association study is adapted to the distribution of the above described phenotypes within the studied population.

After selecting a suitable population, association and haplotype analyses may be performed as described herein to identify one or more biallelic markers associated with drug response, preferably drug toxicity or drug efficacy. The identification of such one or more biallelic markers allows one to conduct diagnostic tests to determine whether the administration of a drug to an individual will result in drug response, preferably drug toxicity, or drug efficacy.

The methods described above for identifying a gene associated with prostate cancer and biallelic markers indicative of a risk of suffering from asthma may be utilized to identify genes associated with other detectable phenotypes. In particular, the above methods may be used with any marker or combination of markers included in the maps of the present invention, including the biallelic markers of SEQ ID Nos.: 1 to 3809 or the sequences complementary thereto. As described above, the general strategy to perform the association studies using the maps and markers of the present invention is to scan two groups of individuals (trait-positive individuals and trait-negative controls) characterized by a well defined phenotype in order to measure the allele frequencies of the biallelic markers in each of these groups. Preferably, the frequencies of markers with inter-marker spacing of about 150 kb are determined in each group. More preferably, the frequencies of markers with inter-marker spacing of about 75 kb are determined in each group. Even more preferably, markers with inter-marker spacing of about 50 kb, about 37.5 kb, about 30 kb, or about 25 kb will be tested in each population.

In some embodiments, the frequencies of 1, 5, 10, 20, 50, 100, 500, 1000, 2000, 3000, or all of the biallelic markers of SEQ ID Nos.: 1 to 3908 or the sequences complementary thereto are measured in each population. In another embodiment, the frequencies of 1, 5, 10, 20, 50, 100, 500, 1000, 2000, or 3000 biallelic markers selected from the group consisting of biallelic markers which are in linkage disequilibrium with the biallelic markers of 1 to 3908 or the sequences complementary thereto are measured in each population. In some embodiments the frequencies of 1, 5, 10, 20, 50, 100, 500, 1000, 2000, or all of the biallelic markers of SEQ ID Nos.: 1 to 2260 or the sequences complementary thereto are measured in each population. In another embodiment, the frequencies of 1, 5, 10, 20, 50, 100, 500, 1000, or 2000 biallelic markers selected from the group consisting of biallelic markers which are in linkage disequilibrium with the biallelic markers of 1 to 2260 or the sequences complementary thereto are measured in each population. In some embodiments the frequencies of 1, 5, 10, 20, 50, 100, 500, 1000, or all of the biallelic markers of SEQ ID Nos.: 2261 to 3734 or the sequences complementary thereto are measured in each population. In another embodiment, the frequencies of 1, 5, 10, 20, 50, 100, 500, 1000 biallelic markers selected from the group consisting of biallelic markers which are in linkage disequilibrium with the biallelic markers of 2261 to 3734 or the sequences complementary thereto are measured in each population. In some embodiments the frequencies of 1, 5, 10, 20, 50, 100, or all of the biallelic markers of SEQ ID Nos.: 3735 to 3908 or the sequences complementary thereto are measured in each population. In another embodiment, the frequencies of 1, 5, 10, 20, 50, or 100 biallelic markers selected from the group consisting of biallelic markers which are in linkage disequilibrium with the biallelic markers of 3735 to 3908 or the sequences complementary thereto are measured in each population.

In some embodiments, the frequencies of about 20,000, or about 40,000 biallelic markers are determined in each population. In a highly preferred embodiment, the frequencies of about 60,000, about 80,000, about 100,000, or about 120,000 biallelic markers are determined in each population. In some embodiments, haplotype analyses may be run using groups of markers located within regions spanning less than 1 kb, from 1 to 5 kb, from 5 to 100 kb, from 10 to 25 kb, from 25 to 50 kb, from 50 to 150 kb, from 150 to 250 kb, from 250 to 500 kb, from 500 kb to 1 Mb, or more than 1 Mb.

Allele frequency can be measured using any genotyping method described herein including microsequencing techniques; preferred high throughput microsequencing procedures are further exemplified in III; it will be further appreciated that any other large scale genotyping method suitable with the intended purpose contemplated herein may also be used.

It will be appreciated that it is not necessary to use a full high density biallelic marker map in order to start a genome-wide association study. Maps having higher densities of biallelic markers (two or more markers per BAC, average inter-marker spacing of about 75 kb or less) may then be generated by starting first on those BACs for which a candidate association has been established at the first step.

In cases when one or more candidate regions have previously been delineated, such as cases where a particular gene or genomic region is suspected of being associated with a trait, local excerpts of biallelic marker maps having densities above one marker per 150 kb may be exploited using BACs harboring said genomic regions, or genes, or portions thereof. In these cases also, successive association studies may be performed using sets of biallelic markers showing increasing densities, preferably from about one every 150 kb to about one every 75 kb; more preferably, sets of markers with inter-marker spacing below about 50 kb, below about 37.5 kb, below about 30 kb, most preferably below about 25 kb, will be used.

Haplotype analyses may also be conducted using groups of biallelic markers within the candidate region. The biallelic markers included in each of these groups may be located within a genomic region spanning less than 1 kb, from 1 to 5 kb, from 5 to 10 kb, from 10 to 25 kb, from 25 to 50 kb, from 50 to 150 kb, from 150 to 250 kb, from 250 to 500 kb, from 500 kb to 1 Mb, or more than 1 Mb. It will be appreciated that the ordered DNA fragments containing these groups of biallelic markers need not completely cover the genomic regions of these lengths but may instead be incomplete contigs having one or more gaps therein. As discussed in further detail below, biallelic markers may be used in association studies and haplotype analyses regardless of the completeness of the corresponding physical contig harboring them, provided linkage disequilibrium between the markers can be assessed.

As described above, if a positive association with a trait, such as a disease, or a drug efficacy and/or toxicity, is identified using the biallelic markers and maps of the present invention, the maps will provide not only the confirmation of the association, but also a shortcut towards the identification of the gene involved in the trait under study. As described above, since the markers showing positive association to the trait are in linkage disequilibrium with the trait loci, the causal gene will be physically located in the vicinity of these markers. Regions identified through association studies using high density maps will on average have a 20–40 times shorter length than those identified by linkage analysis (2 to 20 Mb).

As described above, once a positive association is confirmed with the high density biallelic marker maps of the present invention, BACs from which the most highly associated markers were derived are completely sequenced and the mutations in the causal gene are searched by applying genomic analysis tools. As described above, once a region harboring a gene associated with a detectable trait has been sequenced and analyzed, the candidate functional regions (e.g. exons and splice sites, promoters and other regulatory regions) are scanned for mutations by comparing the sequences of a selected number of controls and cases, using adequate software.

In some embodiments, trait-positive samples being compared to identify causal mutations are selected among those carrying the ancestral haplotype; in these embodiments, control samples are chosen from individuals not carrying said ancestral haplotype.

In further embodiments, trait-positive samples being compared to identify causal mutations are selected among those showing haplotypes that are as close as possible to the ancestral haplotype; in these embodiments, control samples are chosen from individuals not carrying any of the haplotypes selected for the case population.

The maps and biallelic markers of the present invention may also be used to identify patterns of biallelic markers associated with detectable traits resulting from polygenic interactions. The analysis of genetic interaction between alleles at unlinked loci requires individual genotyping using the techniques described herein. The analysis of allelic interaction among a selected set of biallelic markers with appropriate p-values can be considered as a haplotype analysis, similar to those described in further details within the present invention.

IX. Use of Biallelic Markers to Identify Individuals Likely to Exhibit a Detectable Trait Associated with a Particular Allele of a Known Gene In addition to their utility in searches for genes associated with detectable traits on a genome-wide, chromosome-wide, or subchromosomal level, the maps and biallelic markers of the present invention may be used in more targeted approaches for identifying individuals likely to exhibit a particular detectable trait or individuals who exhibit a particular detectable trait as a consequence of possessing a particular allele of a gene associated with the detectable trait. For example, the biallelic markers and maps of the present invention may be used to identify individuals who carry an allele of a known gene that is suspected of being associated with a particular detectable trait. In particular, the target genes may be genes having alleles which predispose an individual to suffer from a specific disease state. In other cases, the target genes may be genes having alleles that predispose an individual to exhibit a desired or undesired response to a drug or other pharmaceutical composition, a food, or any administered compound. The known gene may encode any of a variety of types of biomolecules. For example, the known genes targeted in such analyzes may be genes known to be involved in a particular step in a metabolic pathway in which disruptions may cause a detectable trait. Alternatively, the target genes may be genes encoding receptors or ligands which bind to receptors in which disruptions may cause a detectable trait, genes encoding transporters, genes encoding proteins with signaling activities, genes encoding proteins involved in the immune response, genes encoding proteins involved in hematopoesis, or genes encoding proteins involved in wound healing. It will be appreciated that the target genes are not limited to those specifically enumerated above, but may be any gene known to be or suspected of being associated with a detectable trait.

As previously mentioned, the maps and markers of the present invention may be used to identify genes associated with drug response. The biallelic markers of the present invention may also be used to select individuals for inclusion in the clinical trials of a drug. In some embodiments, the markers of SEQ ID Nos.: 1 to 3908, 1 to 2260, 2261 to 3374, 3735 to 3908 or the sequences complementary thereto may be used in targeted approaches to identify individuals at risk of developing a detectable trait, for example a complex disease or desired/undesired drug response, or to identify individuals exhibiting said trait. The present invention provides methods to establish putative associations between any of the biallelic markers described herein and any detectable traits, including those specifically described herein.

To use the maps and markers of the present invention in further targeted approaches, biallelic markers which are in linkage disequilibrium with any of the above disclosed markers may be identified. In cases where one or more biallelic markers of the present invention have been shown to be associated with a detectable trait, more biallelic markers in linkage disequilibrium with said associated biallelic markers may be generated and used to perform targeted approaches aiming at identifying individuals exhibiting, or likely to exhibit, said detectable trait, according to the methods provided herein.

Furthermore, in cases where a candidate gene is suspected of being associated with a particular detectable trait or suspected of causing the detectable trait, biallelic markers in linkage disequilibrium with said candidate gene may be identified and used in targeted approaches, such as the approaches utilized above for the asthma-associated gene and the Apo E gene.

Biallelic markers that are in linkage disequilibrium with markers associated with a detectable trait, or with genes associated with a detectable trait, or suspected of being so, are identified by performing single marker analyzes, haplotype association analyzes, or linkage disequilibrium measurements on samples from trait-positive and trait-negative individuals as described above using biallelic markers lying in the vicinity of the target marker or gene. In this manner, a single biallelic marker or a group of biallelic markers may be identified which indicate that an individual is likely to possess the detectable trait or does possess the detectable trait as a consequence of a particular allele of the target marker or gene.

Nucleic acid samples from individuals to be tested for predisposition to a detectable trait or possession of a detectable trait as a consequence of a particular allele of the target gene may be examined using the diagnostic methods described above.

Throughout this application, various publications, patents, and published patent applications are cited. The disclosures of the publications, patents, and published patent specifications referenced in this application are hereby incorporated by reference into the present disclosure in their entireties to more fully describe the state of the art to which this invention pertains.

EXAMPLES

Several of the methods of the present invention are described in the following examples, which are offered by way of illustration and not by way of limitation. Many other modifications and variations of the invention as herein set forth can be made without departing from the spirit and scope thereof and therefore only such limitations should be imposed as are indicated by the appended claims.

Example 1

Ordering of a BAC Library: Screening Clones with STSs

The BAC library is screened with a set of PCR-typeable STSs to identify clones containing the STSs. To facilitate PCR screening of several thousand clones, for example 200,000 clones, pools of clones are prepared.

Three-dimensional pools of the BAC libraries are prepared as described in Chumakov et al. and are screened for the ability to generate an amplification fragment in amplification reactions conducted using primers derived from the ordered STSs. (Chumakov et al. (1995), supra). A BAC library typically contains 200,000 BAC clones. Since the average size of each insert is 100–300 kb, the overall size of such a library is equivalent to the size of at least about 7 human genomes. This library is stored as an array of individual clones in 518 384-well plates. It can be divided into 74 primary pools (7 plates each). Each primary pool can then be divided into 48 subpools prepared by using a three-dimensional pooling system based on the plate, row and column address of each clone (more particularly, 7 subpools consisting of all clones residing in a given microtiter plate; 16 subpools consisting of all clones in a given row; 24 subpools consisting of all clones in a given column).

Amplification reactions are conducted on the pooled BAC clones using primers specific for the STSs. For example, the three dimensional pools may be screened with 45,000 STSs whose positions relative to one another and locations along the genome are known. Preferably, the three dimensional pools are screened with about 30,000 STSs whose positions relative to one another and locations along the genome are known. In a highly preferred embodiment, the three dimensional pools are screened with about 20,000 STSs whose positions relative to one another and locations along the genome are known.

Amplification products resulting from the amplification reactions are detected by conventional agarose gel electrophoresis combined with automatic image capturing and processing. PCR screening for a STS involves three steps: (1) identifying the positive primary pools; (2) for each positive primary pool, identifying the positive plate, row and column 'subpools' to obtain the address of the positive clone; (3) directly confirming the PCR assay on the identified clone. PCR assays are performed with primers specifically defining the STS.

Screening is conducted as follows. First BAC DNA containing the genomic inserts is prepared as follows. Bacteria containing the BACs are grown overnight at 37° C. in 120 μl of LB containing chloramphenicol (12 μg/ml). DNA is extracted by the following protocol:

Centrifuge 10 min at 4° C. and 2000 rpm

Eliminate supernatant and resuspend pellet in 120 μl TE 10-2 (Tris HCl 10 mM, EDTA 2 mM)

Centrifuge 10 min at 4° C. and 2000 rpm

Eliminate supernatant and incubate pellet with 20 μl lyzozyme 1 mg/ml during 15 min at room temperature Add 20 μl proteinase K 100 μg/ml and incubate 15 min at 60° C.

Add 8 μl DNAse 2U/μl and incubate 1 hr at room temperature

Add 100 μl TE 10-2 and keep at −80° C.

PCR assays are performed using the following protocol:

| Final volume | 15 μl |
| Final volume | 15 μl |
| BAC DNA | 1.7 ng/μl |
| MgCl$_2$ | 2 mM |
| dNTP (each) | 200 μM |
| primer (each) | 2.9 ng/μl |
| Ampli Taq Gold DNA polymerase | 0.05 unit/μl |
| PCR buffer (10× = 0.1 M TrisHCl pH 8.3 0.5 M KCl | 1× |

The amplification is performed on a Genius II thermocycler. After heating at 95° C. for 10 min, 40 cycles are performed. Each cycle comprises: 30 sec at 95° C., 54° C. for 1 min, and 30 sec at 72° C. For final elongation, 10 min at 72° C. end the amplification. PCR products are analyzed on 1% agarose gel with 0.1 mg/ml ethidium bromide.

Alternatively, a YAC (Yeast Artificial Chromosome) library can be used. The very large insert size, of the order of 1 megabase, is the main advantage of the YAC libraries. The library can typically include about 33,000 YAC clones as described in Chumakov et al. (1995, supra). The YAC screening protocol may be the same as the one used for BAC screening.

The known order of the STSs is then used to align the BAC inserts in an ordered array (contig) spanning the whole human genome. If necessary new STSs to be tested can be generated by sequencing the ends of selected BAC inserts. Subchromosomal localization of the BACs can be established and/or verified by fluorescence in situ hybridization (FISH), performed on metaphasic chromosomes as described by Cherif et al. 1990 and in Example 3 below. BAC insert size may be determined by Pulsed Field Gel Electrophoresis after digestion with the restriction enzyme NotI.

Finally, a minimally overlapping set of BAC clones, with known insert size and subchromosomal location, covering the entire genome, a set of chromosomes, a single chromosome, a particular subchromosomal region, or any other desired portion of the genome is selected from the DNA library. For example, the BAC clones may cover at least 100 kb of contiguous genomic DNA, at least 250 kb of contiguous genomic DNA, at least 500 kb of contiguous genomic DNA, at least 2 Mb of contiguous genomic DNA, at least 5 Mb of contiguous genomic DNA, at least 10 Mb of contiguous genomic DNA, or at least 20 Mb of contiguous genomic DNA.

Example 2

Screening BAC Libraries with Biallelic Markers

Amplification primers enabling the specific amplification of DNA fragments carrying the biallelic markers, including the map-related biallelic markers of the invention, may be used to screen clones in any genomic DNA library, preferably the BAC libraries described above for the presence of the biallelic markers.

Pairs of primers of SEQ ID Nos: 3935 to 7842, 3935 to 6194, 6195 to 7668, 7669 to 7842, 7866 to 11773, 7866 to 10125, 10126 to 11599, and 11600 to 11773 were designed which allow the amplification of fragments carrying the biallelic markers of SEQ ID Nos: 1 to 3908, 1 to 2260, 2261 to 3374, 3735 to 3908 or the sequences complementary thereto. The amplification primers of SEQ ID Nos: 3935 to 7842, 3935 to 6194, 6195 to 7668, 7669 to 7842, 7866 to 11773, 7866 to 10125, 10126 to 11599, and 11600 to 11773 may be used to screen clones in a genomic DNA library for the presence of the biallelic markers of SEQ ID Nos: 1 to 3908, 1 to 2260, 2261 to 3374, 3735 to 3908 or the sequences complementary thereto.

It will be appreciated that amplification primers for the biallelic markers of SEQ ID Nos: 1 to 3908, 1 to 2260, 2261 to 3374, 3735 to 3908 need not be identical to the primers of SEQ ID Nos: 3935 to 7842, 3935 to 6194, 6195 to 7668, 7669 to 7842, 7866 to 11773, 7866 to 10125, 10126 to 11599, and 11600 to 11773. Rather, they can be any other primers allowing the specific amplification of any DNA fragment carrying the markers and may be designed using techniques familiar to those skilled in the art. The amplification primers may be oligonucleotides of 8, 10, 15, 20 or more bases in length which enable the amplification of any fragment carrying the polymorphic site in the markers. The polymorphic base may be in the center of the amplification product or, alternatively, it may be located off-center. For example, in some embodiments, the amplification product produced using these primers may be at least 100 bases in length (i.e. 50 nucleotides on each side of the polymorphic base in amplification products in which the polymorphic base is centrally located). In other embodiments, the amplification product produced using these primers may be at least 500 bases in length (i.e. 250 nucleotides on each side of the polymorphic base in amplification products in which the polymorphic base is centrally located). In still further embodiments, the amplification product produced using these primers may be at least 1000 bases in length (i.e. 500 nucleotides on each side of the polymorphic base in amplification products in which the polymorphic base is centrally located). Amplification primers such as those described above are included within the scope of the present invention.

The localization of biallelic markers on BAC clones is performed essentially as described in Example 1.

The BAC clones to be screened are distributed in three dimensional pools as described in Example 1.

Amplification reactions are conducted on the pooled BAC clones using primers specific for the biallelic markers to identify BAC clones which contain the biallelic markers, using procedures essentially similar to those described in Example 1.

Amplification products resulting from the amplification reactions are detected by conventional agarose gel electrophoresis combined with automatic image capturing and processing. PCR screening for a biallelic marker involves three steps: (1) identifying the positive primary pools; (2) for each positive primary pools, identifying the positive plate, row and column 'subpools' to obtain the address of the positive clone; (3) directly confirming the PCR assay on the identified clone. PCR assays are performed with primers defining the biallelic marker.

Screening is conducted as follows. First BAC DNA is isolated as follows. Bacteria containing the genomic inserts are grown overnight at 37° C. in 120 µl of LB containing chloramphenicol (12 µg/ml). DNA is extracted by the following protocol:

Centrifuge 10 min at 4° C. and 2000 rpm
Eliminate supernatant and resuspend pellet in 120 µl TE 10-2 (Tris HCl 10 mM, EDTA 2 mM)
Centrifuge 10 min at 4° C. and 2000 rpm
Eliminate supernatant and incubate pellet with 20 µl lyzozyme 1 mg/ml during 15 min at room temperature
Add 20 µl proteinase K 100 µg/ml and incubate 15 min at 60° C.
Add 8 µl DNAse 2U/µl and incubate 1 hr at room temperature
Add 100 µl TE 10-2 and keep at −80° C.

PCR assays are performed using the following protocol:

| | |
|---|---|
| Final volume | 15 µl |
| BAC DNA | 1.7 ng/µl |
| MgCl₂ | 2 mM |
| dNTP (each) | 200 µM |
| primer (each) | 2.9 ng/µl |
| Ampli Taq Gold DNA polymerase | 0.05 unit/µl |
| PCR buffer (10× = 0.1 M TrisHCl pH 8.3 0.5 M KCl | 1× |

The amplification is performed on a Genius II thermocycler. After heating at 95° C. for 10 min, 40 cycles are performed. Each cycle comprises: 30 sec at 95° C., 54° C. for 1 min, and 30 sec at 72° C. For final elongation, 10 min at 72° C. end the amplification. PCR products are analyzed on 1% agarose gel with 0.1 mg/ml ethidium bromide.

Example 3

Assignment of Biallelic Markers to Subchromosomal Regions

Metaphase chromosomes are prepared from phytohemagglutinin (PHA)-stimulated blood cell donors. PHA-stimulated lymphocytes from healthy males are cultured for 72 h in RPMI-1640 medium. For synchronization, methotrexate (10 mM) is added for 17 h, followed by addition of 5-bromodeoxyuridine (5-BudR, 0.1 mM) for 6 h. Colcemid (1 mg/ml) is added for the last 15 min before harvesting the cells. Cells are collected, washed in RPMI, incubated with a hypotonic solution of KCl (75 mM) at 37° C. for 15 min and fixed in three changes of methanol:acetic acid (3:1). The cell suspension is dropped onto a glass slide and air-dried.

BAC clones carrying the biallelic markers used to construct the maps of the present invention (including the biallelic markers of SEQ ID Nos: 1 to 3908, 1 to 2260, 2261 to 3374, 3735 to 3908 or the sequences complementary thereto) can be isolated as described above. These BACs or portions thereof, including fragments carrying said biallelic markers, obtained for example from amplification reactions using pairs of primers of SEQ ID Nos: 3935 to 7842, 3935 to 6194, 6195 to 7668, 7669 to 7842, 7866 to 11773, 7866 to 10125, 10126 to 11599, and 11600 to 11773, can be used as probes to be hybridized with metaphasic chromosomes. It will be appreciated that the hybridization probes to be used in the contemplated method may be generated using alternative methods well known to those skilled in the art. Hybridization probes may have any length suitable for this intended purpose.

Probes are then labeled with biotin-16 dUTP by nick translation according to the manufacturer's instructions (Bethesda Research Laboratories, Bethesda, Md.), purified using a Sephadex G-50 column (Pharmacia, Upssala, Sweden) and precipitated. Just prior to hybridization, the DNA pellet is dissolved in hybridization buffer (50% formamide, 2×SSC, 10% dextran sulfate, 1 mg/ml sonicated salmon sperm DNA, pH 7) and the probe is denatured at 70° C. for 5–10 min.

Slides kept at −20° C. are treated for 1 h at 37° C. with RNase A (100 mg/ml), rinsed three times in 2×SSC and dehydrated in an ethanol series. Chromosome preparations are denatured in 70% formamide, 2×SSC for 2 min at 70° C., then dehydrated at 4° C. The slides are treated with proteinase K (10 mg/100 ml in 20 mM Tris-HCl, 2 mM CaCl₂) at 37° C. for 8 min and dehydrated. The hybridization mixture containing the probe is placed on the slide, covered with a coverslip, sealed with rubber cement and incubated overnight in a humid chamber at 37° C. After hybridization and post-hybridization washes, the biotinylated probe is detected by avidin-FITC and amplified with additional layers of biotinylated goat anti-avidin and avidin-FITC. For chromosomal localization, fluorescent R-bands are obtained as previously described (Cherif et al., (1990) supra.). The slides are observed under a LEICA fluorescence microscope (DMRXA). Chromosomes are counterstained with propidium iodide and the fluorescent signal of the probe appears as two symmetrical yellow-green spots on both chromatids of the fluorescent R-band chromosome (red). Thus, a particular biallelic marker may be localized to a particular cytogenetic R-band on a given chromosome.

The above procedure was used to confirm the subchromosomal location of many of the BAC clones harboring the markers obtained above. In particular, several of the markers were assigned to subchromosomal regions of chromosome 21. Simple identification numbers were attributed to each BAC from which the markers are derived. FIG. 1 is a cytogenetic map of chromosome 21 indicating the subchromosomal regions therein. Amplification primers for generating amplification products containing the polymorphic bases of these markers are also provided in the accompanying sequence listing. In addition, microsequencing primers for use in determining the identities of the polymorphic bases of these biallelic markers are provided in the accompanying Sequence Listing.

The rate at which biallelic markers may be assigned to subchromosomal regions may be enhanced through automation. For example, probe preparation may be performed in a microtiter plate format, using adequate robots. The rate at which biallelic markers may be assigned to subchromosomal regions may be enhanced using techniques which permit the in situ hybridization of multiple probes on a single microscope slide, such as those disclosed in Larin et al., *Nucleic Acids Research* 22: 3689–3692 (1994), the disclosure of which is incorporated herein by reference in its entirety. In the largest test format described, different probes were hybridized simultaneously by applying them directly from a 96-well microtiter dish which was inverted on a glass plate. Software for image data acquisition and analysis that is adapted to each optical system, test format, and fluorescent probe used, can be derived from the system described in Lichter et al. *Science* 247: 64–69 (1990), the disclosure of which is incorporated herein by reference in its entirety. Such software measures the relative distance between the center of the fluorescent spot corresponding to the hybridized probe and the telomeric end of the short arm of the corresponding chromosome, as compared to the total length of the chromosome. The rate at which biallelic markers are assigned to subchromosomal locations may be further enhanced by simultaneously applying probes labeled with different flourescent tags to each well of the 96 well dish. A further benefit of conducting the analysis on one slide is that it facilitates automation, since a microscope having a moving stage and the capability of detecting fluorescent signals in different metaphase chromosomes could provide the coordinates of each probe on the metaphase chromosomes distributed on the 96 well dish.

Example 4 below describes an alternative method to position biallelic markers which allows their assignment to human chromosomes.

Example 4

Assignment of Biallelic Markers to Human Chromosomes

The biallelic markers used to construct the maps of the present invention, including the biallelic markers of SEQ ID Nos. 1 to 3908, 1 to 2260, 2261 to 3374, 3735 to 3908 or the sequences complementary thereto, may be assigned to a human chromosome using monosomal analysis as described below.

The chromosomal localization of a biallelic marker can be performed through the use of somatic cell hybrid panels. For example 24 panels, each panel containing a different human chromosome, may be used (Russell et al., *Somat Cell Mol. Genet* 22:425–431 (1996); Drwinga et al., *Genomics* 16:311–314 (1993), the disclosures of which are incorporated herein by reference in their entireties).

The biallelic markers are localized as follows. The DNA of each somatic cell hybrid is extracted and purified. Genomic DNA samples from a somatic cell hybrid panel are prepared as follows. Cells are lysed overnight at 42° C. with 3.7 ml of lysis solution composed of:

3 ml TE 10-2 (Tris HCl 10 mM, EDTA 2 mM)/NaCl 0.4 M

200 µl SDS 10%

500 µl K-proteinase (2 mg K-proteinase in TE 10-2/NaCl 0.4 M)

For the extraction of proteins, 1 ml saturated NaCl (6M) (1/3.5 v/v) is added. After vigorous agitation, the solution is centrifuged for 20 min at 10,000 rpm. For the precipitation of DNA, 2 to 3 volumes of 100% ethanol are added to the previous supernatant, and the solution is centrifuged for 30 min at 2,000 rpm. The DNA solution is rinsed three times with 70% ethanol to eliminate salts, and centrifuged for 20 min at 2,000 rpm. The pellet is dried at 37° C., and resuspended in 1 ml TE 10-1 or 1 ml water. The DNA concentration is evaluated by measuring the OD at 260 nm (1 unit OD=50 µg/ml DNA). To determine the presence of proteins in the DNA solution, the $OD_{260}/OD_{280}$ ratio is determined. Only DNA preparations having a $OD_{260}/OD_{280}$ ratio between 1.8 and 2 are used in the PCR assay.

Then, a PCR assay is performed on genomic DNA with primers defining the biallelic marker. The PCR assay is performed as described above for BAC screening. The PCR products are analyzed on a 1% agarose gel containing 0.2 mg/ml ethidium bromide.

Example 5

Measurement of Linkage Disequilibrium

As originally reported by Strittmater et al. and by Saunders et al. in 1993, the Apo E e4 allele is strongly associated with both late-onset familial and sporadic Alzheimer's disease. (Saunders, A. M. Lancet 342: 710–711 (1993) and Strittmater, W. J. et al., Proc. Natl. Acad. Sci. U.S.A. 90: 1977–1981 (1993), the disclosures of which are incorporated herein by reference in their entireties). The 3 major isoforms of human Apolipoprotein E (apoE2, -E3, and -E4), as identified by isoelectric focusing, are coded for by 3 alleles (e 2, 3, and 4). The e 2, e 3, and e 4 isoforms differ in amino acid sequence at 2 sites, residue 112 (called site A) and residue 158 (called site B). The ancestral isoform of the protein is Apo E3, which at sites A/B contains cysteine/arginine, while ApoE2 and -E4 contain cysteine/cysteine and arginine/arginine, respectively (Weisgraber, K. H. et al., J. Biol. Chem. 256: 9077–9083 (1981); Rall, S. C. et al., Proc. Natl. Acad. Sci. U.S.A. 79: 4696–4700 (1982), the disclosures of which are incorporated herein by reference in their entireties).

Apo E e 4 is currently considered as a major susceptibility risk factor for Alzheimer's disease development in individuals of different ethnic groups (specially in Caucasians and Japanese compared to Hispanics or African Americans), across all ages between 40 and 90 years, and in both men and women, as reported recently in a study performed on 5930 Alzheimer's disease patients and 8607 controls (Farrer et al., *JAMA* 278:1349–1356 (1997), the disclosure of which is incorporated herein by reference in its entirety). More specifically, the frequency of a C base coding for arginine 112 at site A is significantly increased in Alzheimer's disease patients.

Although the mechanistic link between Apo E e 4 and neuronal degeneration characteristic of Alzheimer's disease remains to be established, current hypotheses suggest that the Apo E genotype may influence neuronal vulnerability by increasing the deposition and/or aggregation of the amyloid beta peptide in the brain or by indirectly reducing energy availability to neurons by promoting atherosclerosis.

Using the methods of the present invention, biallelic markers that are in the vicinity of the Apo E site A were generated and the association of one of their alleles with Alzheimer's disease was analyzed. An Apo E public marker (stSG94) was used to screen a human genome BAC library as previously described. A BAC, which gave a unique FISH hybridization signal on chromosomal region 19q13.2.3, the chromosomal region harboring the Apo E gene, was selected for finding biallelic markers in linkage disequilibrium with the Apo E gene as follows.

This BAC contained an insert of 205 kb that was subcloned as previously described. Fifty BAC subclones were randomly selected and sequenced. Twenty five subclone sequences were selected and used to design twenty five pairs of PCR primers allowing 500 bp-amplicons to be generated. These PCR primers were then used to amplify the corresponding genomic sequences in a pool of DNA from 100 unrelated individuals (blood donors of French origin) as already described.

Amplification products from pooled DNA were sequenced and analyzed for the presence of biallelic polymorphisms, as already described. Five amplicons were shown to contain a polymorphic base in the pool of 100 unrelated individuals, and therefore these polymorphisms were selected as random biallelic markers in the vicinity of the Apo E gene. The sequences of both alleles of these biallelic markers (99-344-439; 99-366-274, 99-359-308; 99-355-219; 99-365-344;) correspond to SEQ ID Nos: 3909 to 3913. Corresponding pairs of amplification primers for generating amplicons containing these biallelic markers can be chosen from those listed as SEQ ID Nos: 7843 to 7847 and 11774 to 11778.

An additional pair of primers (SEQ ID Nos: 3124 and 4169) was designed that allows amplification of the genomic fragment carrying the biallelic polymorphism corresponding to the ApoE marker (99-2452-54; C/T; designated SEQ ID NO: 3914 in the accompanying Sequence Listing; publicly known as Apo E site A (Weisgraber et al. (1981), supra; Rall et al. (1982), supra) to be amplified.

The five random biallelic markers plus the Apo E site A marker were physically ordered by PCR screening of the corresponding amplicons using all available BACs originally selected from the genomic DNA libraries, as previously described, using the public Apo E marker stSG94. The amplicon's order derived from this BAC screening is as follows: (99-344-439/99-366-274)-(99-365-344/99-2452-54)-99-359-308-99-355-219, where parentheses indicate that the exact order of the respective amplicons couldn't be established.

Linkage disequilibrium among the six biallelic markers (five random markers plus the Apo E site A) was determined by genotyping the same 100 unrelated individuals from whom the random biallelic markers were identified.

DNA samples and amplification products from genomic PCR were obtained in similar conditions as those described above for the generation of biallelic markers, and subjected to automated microsequencing reactions using fluorescent ddNTPs (specific fluorescence for each ddNTP) and the appropriate microsequencing primers having a 3' end immediately upstream of the polymorphic base in the biallelic markers. Once specifically extended at the 3' end by a DNA polymerase using the complementary fluorescent dideoxynucleotide analog (thermal cycling), the microsequencing primer was precipitated to remove the unincorporated fluorescent ddNTPs. The reaction products were analyzed by electrophoresis on ABI 377 sequencing machines. Results were automatically analyzed by an appropriate software further described in Example 8.

Linkage disequilibrium (LD) between all pairs of biallelic markers ($M_i$, $M_j$) was calculated for every allele combination (Mi1,Mj1; Mi1,Mj2; Mi2,Mj1; Mi2,Mj2) according to the maximum likelihood estimate (MLE) for delta (the composite linkage disequilibrium coefficient). The results of the linkage disequilibrium analysis between the Apo E Site A marker and the five new biallelic markers (99-344-439; 99-355-219; 99-359-308; 99-365-344; 99-366-274) are summarized in Table 2 below:

TABLE 2

| Markers | d × 100 APOE Site A 99-2452-54 | SEQ ID Nos of the biallelic Markers | SEQ ID Nos of the amplification Primers |
|---|---|---|---|
| ApoE Site A 99-2452-54 | | 3914 | 7848; 11779 |
| 99-344-439 | 1 | 3909 | 7843, 11774 |
| 99-366-274 | 1 | 3910 | 7844, 11775 |
| 99-365-344 | 8 | 3913 | 7847, 11778 |
| 99-359-308 | 2 | 3911 | 7845, 11776 |
| 99-355-219 | 1 | 3912 | 7846, 11777 |

The above linkage disequilibrium results indicate that among the five biallelic markers randomly selected in a region of about 200 kb containing the Apo E gene, marker 99-365-344T is in relatively strong linkage disequilibrium with the Apo E site A allele (99-2452-54C).

Therefore, since the Apo E site A allele is associated with Alzheimer's disease, one can predict that the T allele of marker 99-365-344 will probably be found associated with Alzheimer's disease. In order to test this hypothesis, the biallelic markers of SEQ ID Nos: 3909 to 3913 were used in association studies as described below.

225 Alzheimer's disease patients were recruited according to clinical inclusion criteria based on the MMSE test. The 248 control cases included in this study were both ethnically- and age-matched to the affected cases. Both affected and control individuals corresponded to unrelated cases. The identities of the polymorphic bases of each of the biallelic markers was determined in each of these individuals using the methods described above. Techniques for conducting association studies are further described below.

The results of this study are summarized in Table 3 below:

TABLE 3

| | ASSOCIATION DATA | |
|---|---|---|
| MARKER | Difference in allele frequency between individuals with Alzheimer's and control individuals | Corresponding p-value |
| 99-344-439 | 3.3% | 9.54 E-02 |
| 99-366-274 | 1.6% | 2.09 E-01 |
| 99-365-344 | 17.7% | 6.9 E-10 |
| 99-2452-54 (ApoE Site A) | 23.8% | 3.95 E-21 |
| 99-359-308 | 0.4% | 9.2 E-01 |
| 99-355-219 | 2.5% | 2.54 E-01 |

The frequency of the Apo E site A allele in both Alzheimer's disease cases and controls was found in agreement with that previously reported (ca. 10% in controls and ca. 34% in Alzheimer's disease cases, leading to a 24% difference in allele frequency), thus validating the Apo E e4 association in the populations used for this study.

Moreover, as predicted from the linkage disequilibrium analysis (Table 3), a significant association of the T allele of marker 99-365/344 with Alzheimer's disease cases (18% increase in the T allele frequency in Alzheimer's disease cases compared to controls, p value for this difference=6.9 E-10) was observed.

The above results indicate that any marker in linkage disequilibrium with one given marker associated with a trait will be associated with the trait. It will be appreciated that, though in this case the ApoE Site A marker is the trait-causing allele (TCA) itself, the same conclusion could be drawn with any other non trait-causing allele marker associated with the studied trait.

These results further indicate that conducting association studies with a set of biallelic markers randomly generated within a candidate region at a sufficient density (here about one biallelic marker every 40 kb on average), allows the identification of at least one marker associated with the trait.

In addition, these results correlate with the physical order of the six biallelic markers contemplated within the present example (see above): marker 99-365/344, which had been found to be the closest in terms of physical distance to the ApoE Site A marker, also shows the strongest linkage disequilibrium with the Apo E site A marker.

In order to further refine the relationship between physical distance and linkage disequilibrium between biallelic markers, a ca. 450 kb fragment from a genomic region on chromosome 8 was fully sequenced.

LD within ca. 230 pairs of biallelic markers derived therefrom was measured in a random French population and analyzed as a function of the known physical inter-marker spacing. This analysis confirmed that, on average, linkage disequilibrium between 2 biallelic markers correlates with the physical distance that separates them. It further indicated that linkage disequilibrium between 2 biallelic markers tends to decrease when their spacing increases. More particularly, linkage disequilibrium between 2 biallelic markers tends to decrease when their inter-marker distance is greater than 50 kb, and is further decreased when the inter-marker distance is greater than 75 kb. It was further observed that when 2 biallelic markers were further than 150 kb apart, most often no significant linkage disequilibrium between them could be evidenced. It will be appreciated that the size and history of the sample population used to measure linkage disequilibrium between markers may influence the distance beyond which linkage disequilibrium tends not to be detectable. Assuming that linkage disequilibrium can be measured between markers spanning regions up to an average of 150 kb long, biallelic marker maps will allow genome-wide linkage disequilibrium mapping, provided they have an average inter-marker distance lower than 150 kb.

Example 6

Identification of a Candidate Region Harboring a Gene Associated with a Detectable Trait The initial identification of a candidate genomic region harboring a gene associated with a detectable trait may be conducted using a genome-wide map comprising about 20,000 biallelic markers. The candidate genomic region may be further defined using a map having a higher marker density, such as a map comprising about 40,000 markers, about 60,000 markers, about 80,000 markers, about 100,000 markers, or about 120,000 markers.

The use of high density maps such as those described above allows the identification of genes which are truly associated with detectable traits, since the coincidental associations will be randomly distributed along the genome while the true associations will map within one or more discrete genomic regions. Accordingly, biallelic markers located in the vicinity of a gene associated with a detectable trait will give rise to broad peaks in graphs plotting the frequencies of the biallelic markers in trait-positive individuals versus control individuals. In contrast, biallelic markers which are not in the vicinity of the gene associated with the detectable trait will produce unique points in such a plot. By determining the association of several markers within the region containing the gene associated with the detectable trait, the gene associated with the detectable trait can be identified using an association curve which reflects the difference between the allele frequencies within the trait-positive and control populations for each studied marker. The gene associated with the detectable trait will be found in the vicinity of the marker showing the highest association with the trait.

Figure 4:
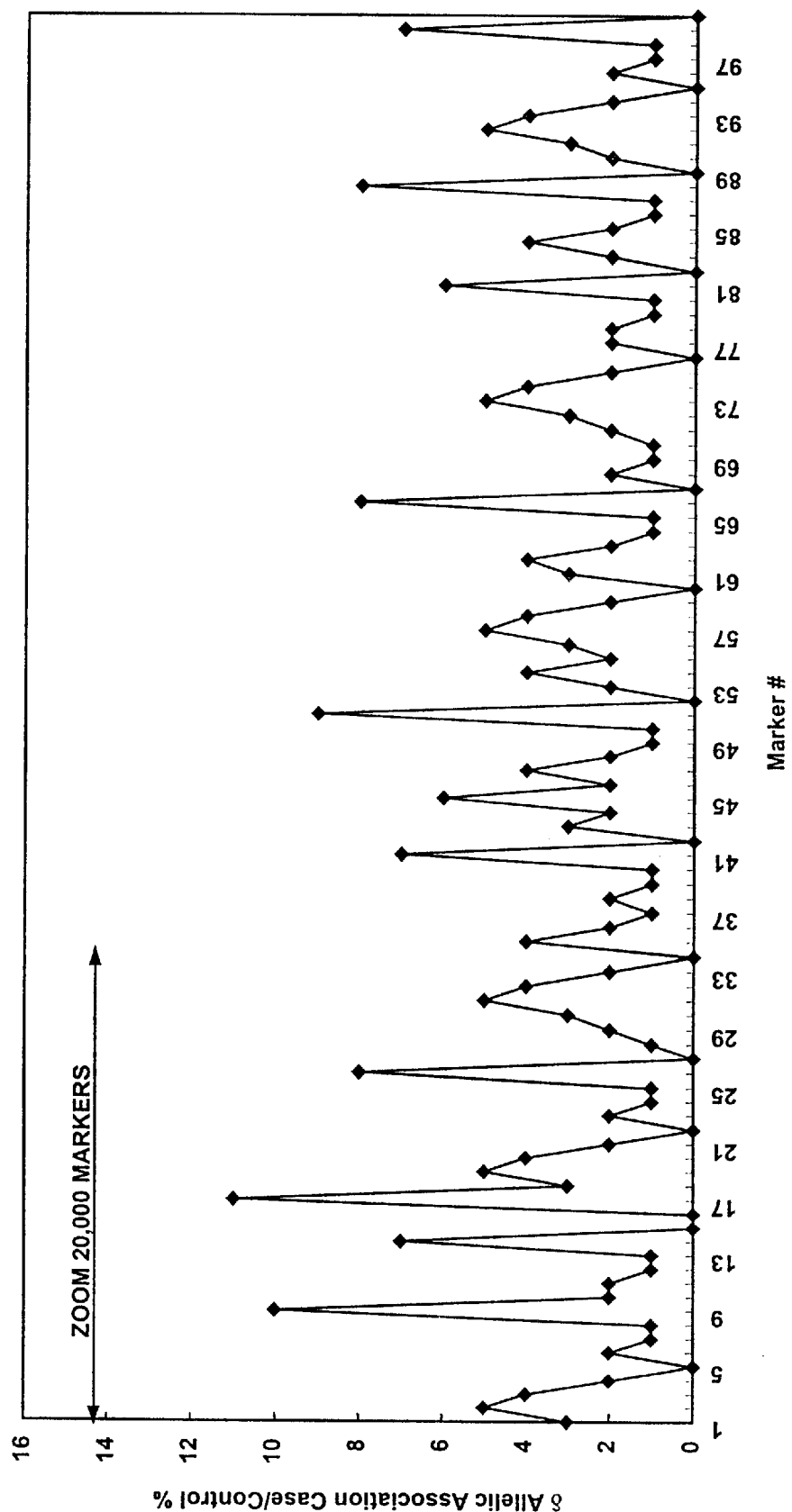
FIG. 4 is a hypothetical association analysis conducted with a map comprising about 3,000 biallelic markers.
Figure 5:
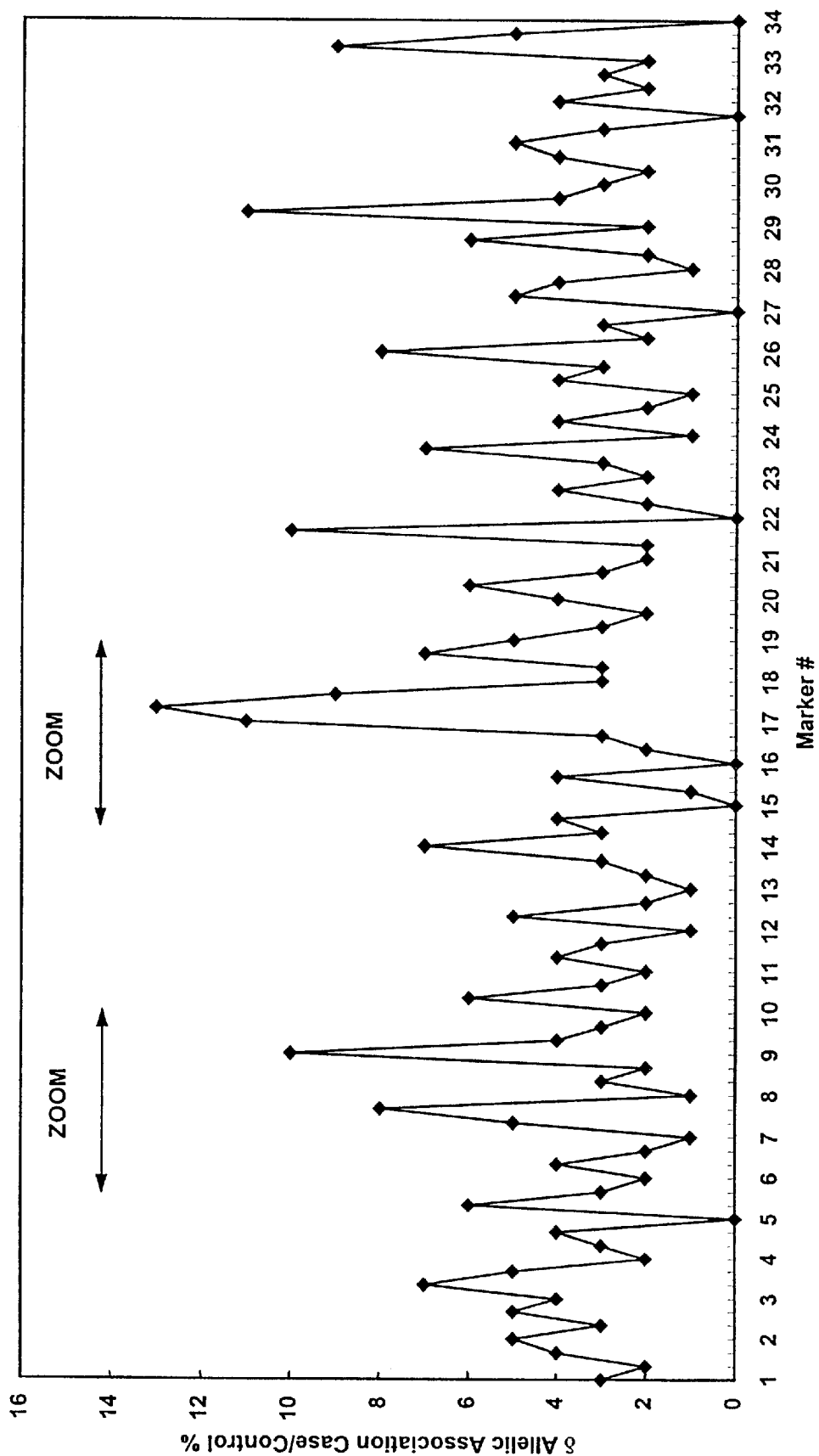
FIG. 5 is a hypothetical association analysis conducted with a map comprising about 20,000 biallelic markers.
Figure 6:
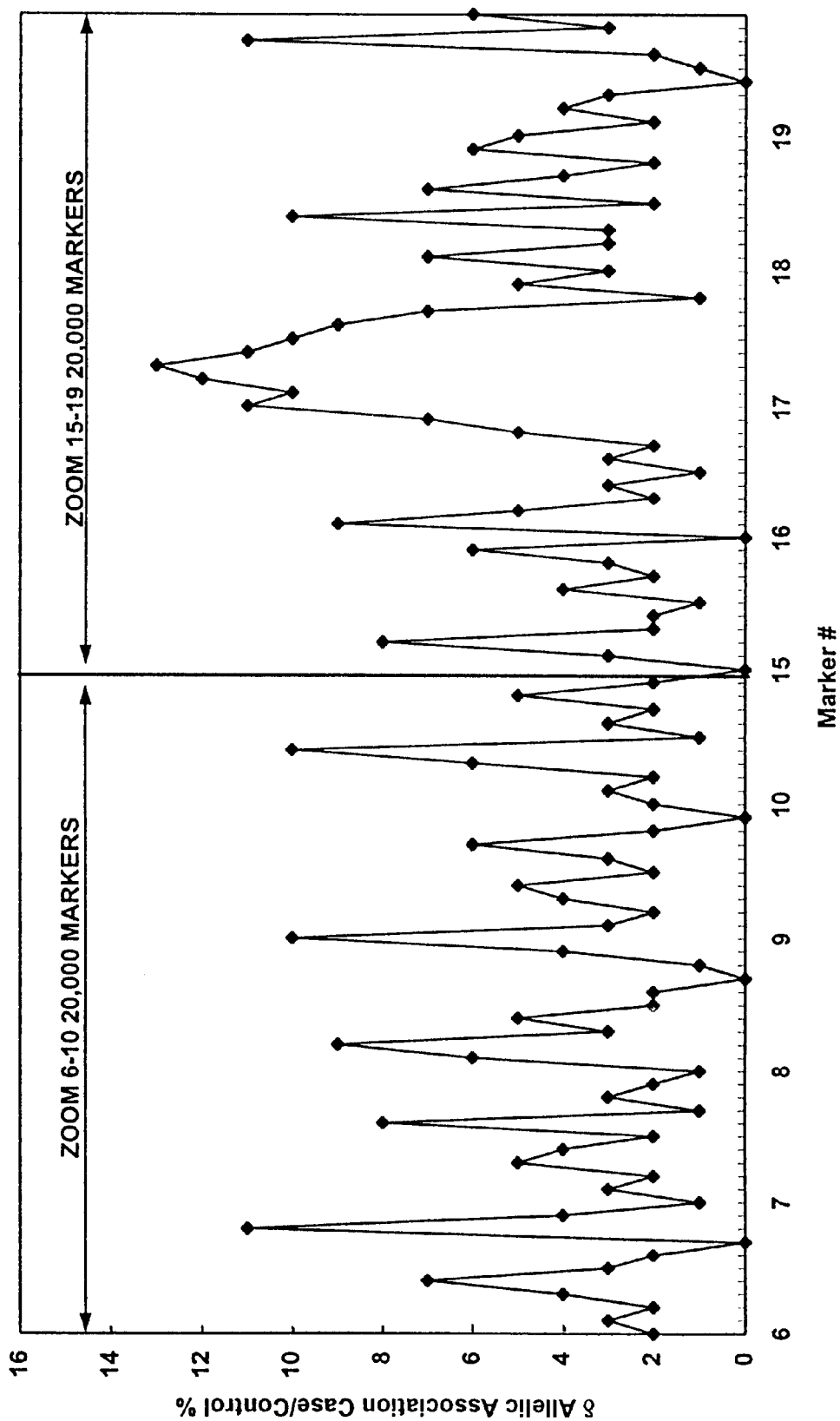
FIG. 6 is a hypothetical association analysis conducted with a map comprising about 60,000 biallelic markers.

FIGS. 4, 5, and 6 provide a simulated illustration of the above principles. As illustrated in FIG. 4, an association analysis conducted with a map comprising about 3,000 biallelic markers yields a group of points. However, when an association analysis is performed using a denser map which includes additional biallelic markers, the points become broad peaks indicative of the location of a gene associated with a detectable trait. For example, the biallelic markers used in the initial association analysis may be obtained from a map comprising about 20,000 biallelic markers, as illustrated by the simulation results shown in FIG. 5. In some embodiments, one or more of the biallelic markers of SEQ ID Nos. 1 to 3908, 1 to 2260, 2261 to 3374, 3735 to 3908 or the sequences complementary thereto are used in the association analysis.

In the simulated results of FIG. 4, the association analysis with 3,000 markers suggests peaks near markers 9 and 17.

Next, a second analysis is performed using additional markers in the vicinity of markers 9 and 17, as illustrated in the simulated results of FIG. 5, using a map of about 20,000 markers. This step again indicates an association in the close vicinity of marker 17, since more markers in this region show an association with the trait. However, none of the additional markers around marker 9 shows a significant association with the trait, which makes marker 9 a potential false positive. In some embodiments, one or more of the biallelic markers selected from the group consisting of SEQ ID Nos. 1 to 3908, 1 to 2260, 2261 to 3374, 3735 to 3908 or the sequences complementary thereto are used in the second analysis. In order to further test the validity of these two suspected associations, a third analysis may be obtained with a map comprising about 60,000 biallelic markers. In some embodiments, one or more of the biallelic markers selected from the group consisting of SEQ ID Nos: 1 to 3908, 1 to 2260, 2261 to 3374, 3735 to 3908 or the sequences complementary thereto are used in the third association analysis. In the simulated results of FIG. 6, more markers lying around marker 17 exhibit a high degree of association with the detectable trait. Conversely, no association is confirmed in the vicinity of marker 9. The genomic region surrounding marker 17 can thus be considered a candidate region for the potential trait of this simulation.

Example 7

Haplotype Analysis: Identification of Biallelic Markers Delineating a Genomic Region Associated with Alzheimer's Disease (AD)

As shown in Table 3 within Example 5, at an average map density of one marker per 40 kb only one marker (99-365-344) out of five random biallelic markers from a ca. 200 kb genomic region around the Apo E gene showed a clear association to Alzheimer's disease (delta allelic frequency in cases and controls=18%; p value=6.9 E-10). The allelic frequencies of the other four random markers were not significantly different between Alzheimer's disease cases and controls (p-values≧E-01). However, since linkage disequilibrium can usually be detected between markers located further apart than an average 40 kb as previously discussed, one should expect that, performing an association study with a local excerpt of a biallelic marker map covering ca. 200 kb with an average inter-marker distance of ca. 40 kb should allow the identification of more than one biallelic marker associated with Alzheimer's disease.

A haplotype analysis was thus performed using the biallelic markers 99-344-439; 99-355-219; 99-359-308; 99-365-344; and 99-366-274 (of SEQ ID Nos: 3909 to 3919).

In a first step, marker 99-365-344 that was already found associated with Alzheimer's disease was not included in the haplotype study. Only biallelic markers 99-344-439, 99-355-219, 99-359-308, and 99-366-274, which did not show any significant association with Alzheimer's disease when taken individually, were used. This first haplotype analysis measured frequencies of all possible two-, three-, or four-marker haplotypes in the Alzheimer's disease case and control populations. As shown in FIG. 7, there was one haplotype among all the potential different haplotypes based on the four individually non-significant markers ("haplotype 8", TAGG comprising SEQ ID No. 3910 with the T allele of marker 99-366-274, SEQ ID No. 3909 with the A allele of marker 99-344-439, SEQ ID No. 3911 with the G allele of marker 99-359-308 and SEQ ID No. 3912 which is the G allele of marker 99-355-219), that was present at statistically significant different frequencies in the Alzheimer's disease case and control populations (D=12%; p value=2.05 E-06). Moreover, a significant difference was already observed for a three-marker haplotype included in the above mentioned "haplotype 8" ("haplotype 7", TGG, D=10%; p value=4.76 E-05). Haplotype 7 comprises SEQ ID No. 3910 with the T allele of marker 99-366-274, SEQ ID No. 3911 with the G allele of marker 99-359-308 and SEQ ID No. 3912 with the G allele of marker 99-355-219). The haplotype association analysis thus clearly increased the statistical power of the individual marker association studies by more than four orders of magnitude when compared to single-marker analysis from p values≧E-01 for the individual markers to p value<2 E-06 for the four-marker "haplotype 8". See Table 3.

Figure 8:
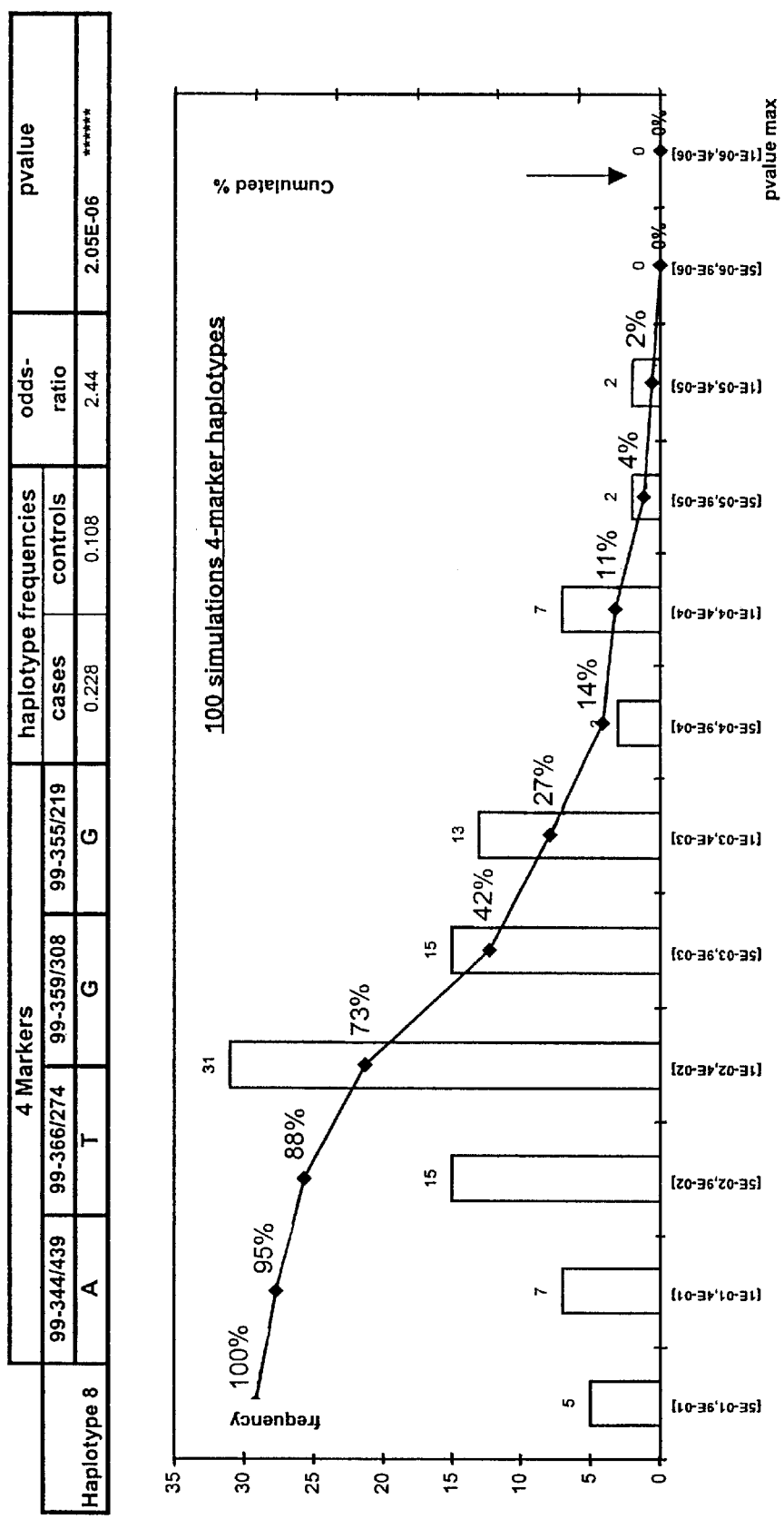
FIG. 8 is a simulated haplotype analysis using the biallelic markers in the Apo E region included in the haplotype analysis of FIG. 7.

The significance of the values obtained for this haplotype association analysis was evaluated by the following computer simulation. The genotype data from the Alzheimer's disease cases and the unaffected controls were pooled and randomly allocated to two groups which contained the same number of individuals as the case/control groups used to produce the data summarized in FIG. 7. A four-marker haplotype analysis (99-344-439; 99-355-219; 99-359-308; and 99-366-274) was run on these artificial groups. This experiment was reiterated 100 times and the results are shown in FIG. 8. No haplotype among those generated was found for which the p-value of the frequency difference between both populations was more significant than 1 E-05. In addition, only 4% of the generated haplotypes showed p-values lower than 1 E-04. Since both these p-value thresholds are less significant than the 2 E-06 p-value showed by "haplotype 8", this haplotype can be considered significantly associated with Alzheimer's disease.

In a second step, marker 99-365-344 was included in the haplotype analyzes. The frequency differences between the affected and non affected populations was calculated for all two-, three-, four- or five-marker haplotypes involving markers: 99-344-439; 99-355-219; 99-359-308; 99-366-274; and 99-365-344. The most significant p-values obtained in each category of haplotype (involving two, three, four or five markers) were examined depending on which markers were involved or not within the haplotype. This showed that all haplotypes which included marker 99-36S-344 showed a significant association with Alzheimer's disease (p-values in the range of E-04 to E-11).

An additional way of evaluating the significance of the values obtained in the haplotype association analysis was to perform a similar Alzheimer's disease case-control study on biallelic markers generated from BACs containing inserts corresponding to genomic regions derived from chromosomes 13 or 21 and not known to be involved in Alzheimer's disease. Performing similar haplotype and individual association analyzes as those described above and in Example 10 did not generate any significant association results (all p-values for haplotype analyzes were less significant than E-03; all p-values for single marker association studies were less significant than E-02).

Example 8

Genotyping of Biallelic Markers Using Microsequencing Procedures

Several microsequencing protocols conducted in liquid phase are well known to those skilled in the art. A first possible detection analysis allowing the allele characterization of the microsequencing reaction products relies on detecting fluorescent ddNTP-extended microsequencing primers after gel electrophoresis. A first alternative to this approach consists in performing a liquid phase microsequencing reaction, the analysis of which may be carried out in solid phase.

For example, the microsequencing reaction may be performed using 5'-biotinylated oligonucleotide primers and fluorescein-dideoxynucleotides. The biotinylated oligonucleotide is annealed to the target nucleic acid sequence immediately adjacent to the polymorphic nucleotide position of interest. It is then specifically extended at its 3'-end following a PCR cycle, wherein the labeled dideoxynucleotide analog complementary to the polymorphic base is incorporated. The biotinylated primer is then captured on a microtiter plate coated with streptavidin. The analysis is thus entirely carried out in a microtiter plate format. The incorporated ddNTP is detected by a fluorescein antibody—alkaline phosphatase conjugate.

In practice this microsequencing analysis is performed as follows. 20 $\mu$l of the microsequencing reaction is added to 80 $\mu$l of capture buffer (SSC 2x, 2.5% PEG 8000, 0.25 M Tris pH7.5, 1.8% BSA, 0.05% Tween 20) and incubated for 20 minutes on a microtiter plate coated with streptavidin (Boehringer). The plate is rinsed once with washing buffer (0.1 M Tris pH 7.5, 0.1 M NaCl, 0.1% Tween 20). 100 $\mu$l of anti-fluorescein antibody conjugated with phosphatase alkaline, diluted 1/5000 in washing buffer containing 1.8% BSA is added to the microtiter plate. The antibody is incubated on the microtiter plate for 20 minutes. After washing the microtiter plate four times, 100 $\mu$l of 4-methylumbelliferyl phosphate (Sigma) diluted to 0.4 mg/ml in 0.1 M diethanolamine pH 9.6, 10mM $MgCl_2$ are added. The detection of the microsequencing reaction is carried out on a fluorimeter (Dynatech) after 20 minutes of incubation.

As another alternative, solid phase microsequencing reactions have been developed, for which either the oligonucleotide microsequencing primers or the PCR-amplified products derived from the DNA fragment of interest are immobilized. For example, immobilization can be carried out via an interaction between biotinylated DNA and streptavidin-coated microtitration wells or avidin-coated polystyrene particles.

As a further alternative, the PCR reaction generating the amplicons to be genotyped can be performed directly in solid phase conditions, following procedures such as those described in WO 96/13609, the disclosure of which is incorporated herein by reference in its entirety.

In such solid phase microsequencing reactions, incorporated ddNTPs can either be radiolabeled (see Syvänen, *Clin. Chim. Acta.* 226:225–236 (1994), the disclosure of which is incorporated herein by reference in its entirety) or linked to fluorescein (see Livak and Hainer, *Hum. Metat.* 3:379–385 (1994), the disclosure of which is incorporated herein by reference in its entirety). The detection of radiolabeled ddNTPs can be achieved through scintillation-based techniques. The detection of fluorescein-linked ddNTPs can be based on the binding of antifluorescein antibody conjugated with alkaline phosphatase, followed by incubation with a chromogenic substrate (such as p-nitrophenyl phosphate).

Other possible reporter-detection couples for use in the above microsequencing procedures include:

ddNTP linked to dinitrophenyl (DNP) and anti-DNP alkaline phosphatase conjugate (see Harju et al., *Clin Chem*:39(11Pt 1):2282–2287 (1993), incorporated herein by reference in its entirety)

biotinylated ddNTP and horseradish peroxidase-conjugated streptavidin with o-phenylenediamine as a substrate (see WO 92/15712, incorporated herein by reference in its entirety).

A diagnosis kit based on fluorescein-linked ddNTP with antifluorescein antibody conjugated with alkaline phosphatase has been commercialized under the name PRONTO by GamidaGen Ltd.

As yet another alternative microsequencing procedure, Nyren et al. (*Anal. Biochem.* 208:171–175 (1993), the disclosure of which is incorporated herein by reference in its entirety) have described a solid-phase DNA sequencing procedure that relies on the detection of DNA polymerase activity by an enzymatic luminometric inorganic pyrophosphate detection assay (ELIDA). In this procedure, the PCR-amplified products are biotinylated and immobilized on beads. The microsequencing primer is annealed and four aliquots of this mixture are separately incubated with DNA polymerase and one of the four different ddNTPs. After the reaction, the resulting fragments are washed and used as substrates in a primer extension reaction with all four dNTPs present. The progress of the DNA-directed polymerization reactions is monitored with the ELIDA. Incorporation of a ddNTP in the first reaction prevents the formation of pyrophosphate during the subsequent dNTP reaction. In contrast, no ddNTP incorporation in the first reaction gives extensive pyrophosphate release during the dNTP reaction and this leads to generation of light throughout the ELIDA reactions. From the ELIDA results, the identity of the first base after the primer is easily deduced.

It will be appreciated that several parameters of the above-described microsequencing procedures may be successfully modified by those skilled in the art without undue experimentation. In particular, high throughput improvements to these procedures may be elaborated, following principles such as those described further below.

Example 9

Sequence Analysis

DNA sequences, such as BAC inserts, containing the region carrying the candidate gene associated with the detectable trait are sequenced and their sequence is analyzed using automated software which eliminates repeat sequences while retaining potential gene sequences. The potential gene sequences are compared to numerous databases to identify potential exons using a set of scoring algorithms such as trained Hidden Markov Models, statistical analysis models (including promoter prediction tools) and the GRAIL neural network. Preferred databases for use in this analysis, the construction and use of which are further detailed in Example 17, include the following:

NRPU (Non-Redundant Protein-Unique) database: NRPU is a non-redundant merge of the publicly available NBRF/PIR, Genpept, and SwissProt databases. Homologies found with NRPU allow the identification of regions potentially coding for already known proteins or related to known proteins (translated exons).

NREST (Non-Redundant EST database): NREST is a merge of the EST subsection of the publicly available GenBank database. Homologies found with NREST allow the location of potentially transcribed regions (translated or non-translated exons).

NRN (Non-Redundant Nucleic acid database): NRN is a merge of GenBank, EMBL and their daily updates.

Any sequence giving a positive hit with NRPU, NREST or an "excellent" score using GRAIL or/and other scoring algorithms is considered a potential functional region, and is then considered a candidate for genomic analysis.

While this first screening allows the detection of the "strongest" exons, a semi-automatic scan is further applied to the remaining sequences in the context of the sequence assembly. That is, the sequences neighboring a 5' site or an exon are submitted to another round of bioinformatics analysis with modified parameters. In this way, new exon candidates are generated for genomic analysis.

Using the above procedures, genes associated with detectable traits may be identified.

Example 10

YAC Contig Construction in the Candidate Genomic Region

Substantial amounts of LOH data supported the hypothesis that genes associated with distinct cancer types are located within a particular region of the human genome. More specifically, this region was likely to harbor a gene associated with prostate cancer.

Association studies were performed as described below in order to identify this prostate cancer gene. First, a YAC contig which contains the candidate genomic region was constructed as follows. The CEPH-Genethon YAC map for the entire human genome (Chumakov et al. (1995), supra) was used for detailed contig building in the genomic region containing genetic markers known to map in the candidate genomic region. Screening data available for several publicly available genetic markers were used to select a set of CEPH YACs localized within the candidate region. This set of YACs was tested by PCR with the above mentioned genetic markers as well as with other publicly available markers supposedly located within the candidate region. As a result of these studies, a YAC STS contig map was generated around genetic markers known to map in this genomic region. Two CEPH YACs were found to constitute a minimal tiling path in this region, with an estimated size of ca. 2 Megabases.

During this mapping effort, several publicly known STS markers were precisely located within the contig.

Example 11 below describes the identification of sets of biallelic markers within the candidate genomic region.

Example 11

BAC Contig Construction and Biallelic Markers Isolation Within the Candidate Chromosomal Region Next, a BAC contig covering the candidate genomic region was constructed as follows. BAC libraries were obtained as described in Woo et al., *Nucleic Acids Res.* 22:4922–4931 (1994), the disclosure of which is incorporated herein by reference in its entirety. Briefly, the two whole human genome BamHI and HindIII libraries already described in related WIPO application No. PCT/IB98/00193 were constructed using the pBeloBAC11 vector (Kim et al. (1996), supra).

The BAC libraries were then screened with all of the above mentioned STSs, following the procedure described in Example 1 above.

The ordered BACs selected by STS screening and verified by FISH, were assembled into contigs and new markers were generated by partial sequencing of insert ends from some of them. These markers were used to fill the gaps in the contig of BAC clones covering the candidate chromosomal region having an estimated size of 2 megabases.

Figure 9:
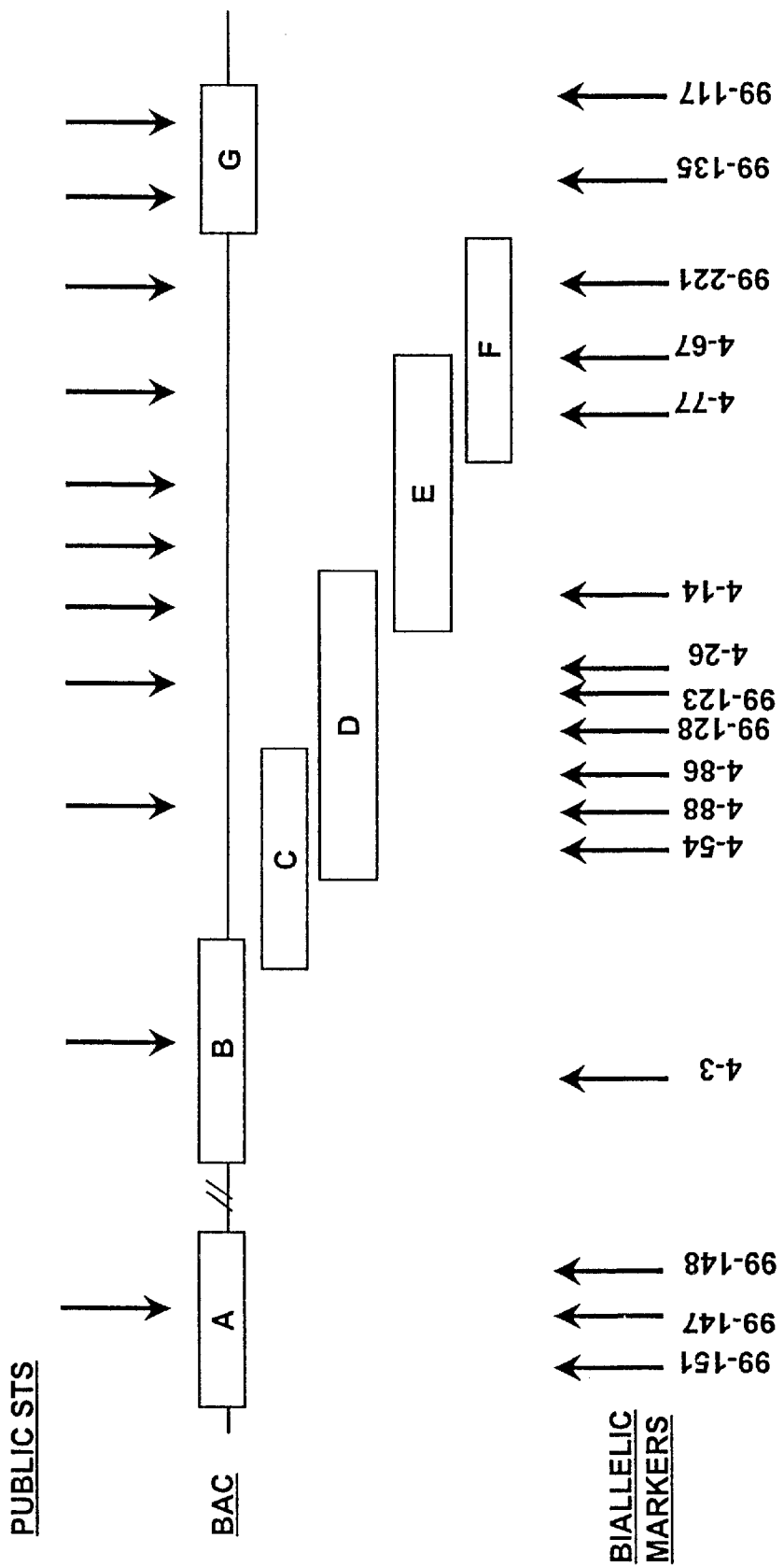
FIG. 9 shows a minimal array of overlapping clones which was chosen for further studies of biallelic markers associated with prostate cancer, the positions of STS markers known to map in the candidate genomic region along the contig, and the locations of biallelic markers along the BAC contig harboring a genomic region harboring a candidate gene associated with prostate cancer which were identified using the methods of the present invention.

FIG. 9 illustrates a minimal array of overlapping clones which was chosen for further studies, and the positions of the publicly known STS markers along said contig.

Selected BAC clones from the contig were subcloned and sequenced, essentially following the procedures described in related WIPO application No. PCT/IB98/00193.

Biallelic markers lying along the contig were identified following the processes described in related WIPO application No. PCT/IB98/00193, the disclosure of which is incorporated herein by reference in its entirety.

FIG. 9 shows the locations of the biallelic markers along the BAC contig. This first set of markers corresponds to a medium density map of the candidate locus, with an inter-marker distance averaging 50 kb–150 kb.

A second set of biallelic markers was then generated as described above in order to provide a very high-density map of the region identified using the first set of markers which can be used to conduct association studies, as explained below. This very high density map has markers spaced on average every 2–50 kb.

The biallelic markers were then used in association studies. DNA samples were obtained from individuals suffering from prostate cancer and unaffected individuals as described in Example 12.

Example 12

Collection of DNA Samples from Affected and Non-affected Individuals

Prostate cancer patients were recruited according to clinical inclusion criteria based on pathological or radical prostatectomy records. Control cases included in this study were both ethnically- and age-matched to the affected cases; they were checked for both the absence of all clinical and biological criteria defining the presence or the risk of prostate cancer, and for the absence of related familial prostate cancer cases. Both affected and control individuals were all unrelated.

The two following groups of independent individuals were used in the association studies. The first group, comprising individuals suffering from prostate cancer, contained 185 individuals. Of these 185 cases of prostate cancer, 47 cases were sporadic and 138 cases were familial. The control group contained 104 non-diseased individuals.

Haplotype analysis was conducted using additional diseased (total samples: 281) and control samples (total samples: 130), from individuals recruited according to similar criteria.

DNA was extracted from peripheral venous blood of all individuals as described in related WIPO application No. PCT/IB98/00193.

The frequencies of the biallelic markers in each population were determined as described in Example 13.

Example 13

Genotyping Affected and Control Individuals

Genotyping was performed using the following microsequencing procedure. Amplification was performed on each DNA sample using primers designed as previously explained. The pairs of primers of SEQ ID Nos.: 7849 to 7860 and 11780 to 11791 were used to generate amplicons harboring the biallelic markers of SEQ ID Nos: 3915 to 3926 or the sequences complementary thereto (markers 99-123-381, 4-26-29, 4-14-240, 4-77-151, 99-217-277, 4-67-40, 99-213-164, 99-221-377, 99-135-196, 99-1482-32, 4-73-134, and 4-65-324) using the protocols described in related WIPO application No. PCT/IB98/00193.

Microsequencing primers were designed for each of the biallelic markers, as previously described. After purification of the amplification products, the microsequencing reaction mixture was prepared by adding, in a 20 μl final volume: 10 pmol microsequencing oligonucleotide, 1 U Thermosequenase (Amersham E79000G), 1.25 μl Thermosequenase buffer (260 mM Tris HCl pH 9.5, 65 mM $MgCl_2$), and the two appropriate fluorescent ddNTPs (Perkin Elmer, Dye Terminator Set 401095) complementary to the nucleotides at the polymorphic site of each biallelic marker tested, following the manufacturer's recommendations. After 4 minutes at 94° C., 20 PCR cycles of 15 sec at 55° C., 5 sec at 72° C., and 10 sec at 94° C. were carried out in a Tetrad PTC-225 thermocycler (MJ Research). The unincorporated dye terminators were then removed by ethanol precipitation. Samples were finally resuspended in formamide-EDTA loading buffer and heated for 2 min at 95° C. before being loaded on a polyacrylamide sequencing gel. The data were collected by an ABI PRISM 377 DNA sequencer and processed using the GENESCAN software (Perkin Elmer).

Following gel analysis, data were automatically processed with software that allows the determination of the alleles of biallelic markers present in each amplified fragment.

The software evaluates such factors as whether the intensities of the signals resulting from the above microsequencing procedures are weak, normal, or saturated, or whether the signals are ambiguous. In addition, the software identifies significant peaks (according to shape and height criteria). Among the significant peaks, peaks corresponding to the targeted site are identified based on their position. When two significant peaks are detected for the same position, each sample is categorized as homozygous or heterozygous based on the height ratio.

Association analyzes were then performed using the biallelic markers as described below.

Example 14

Association Analysis

Figure 10:
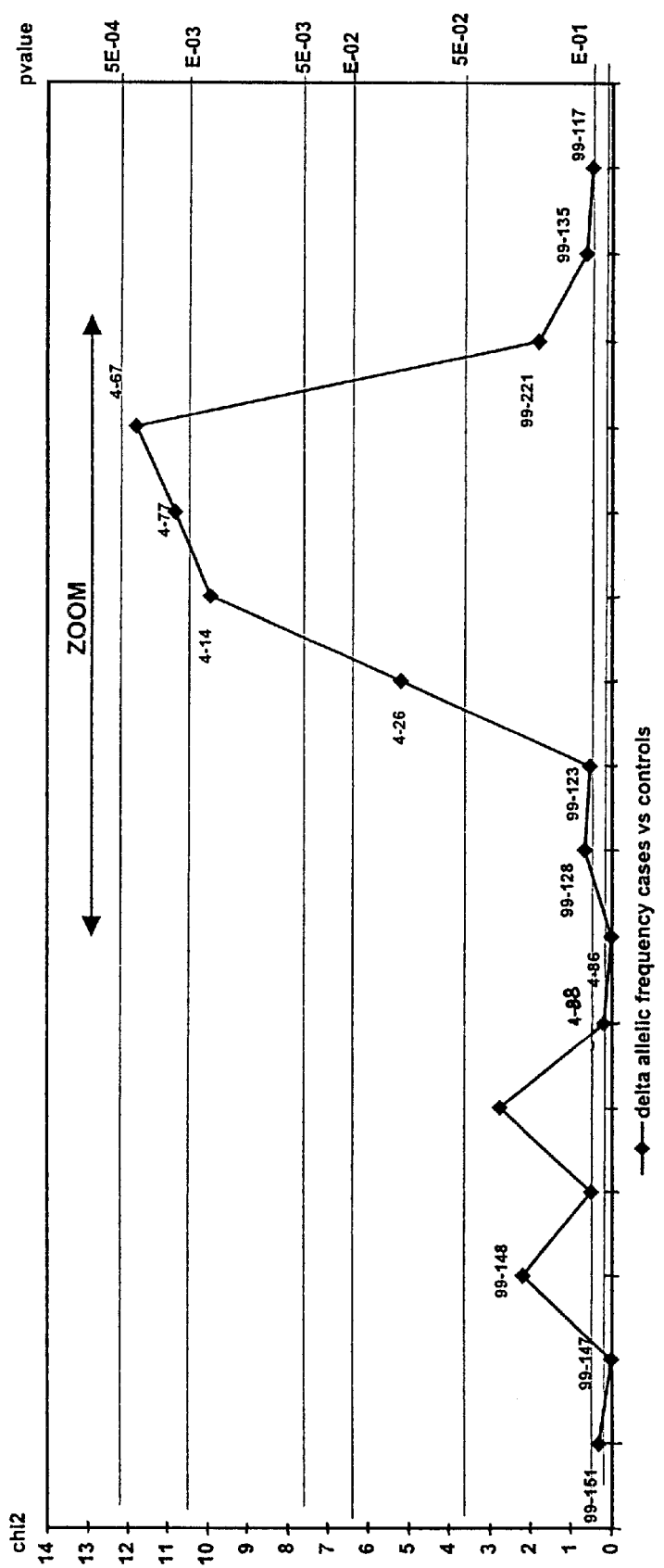
FIG. 10 is a rough localization of a candidate gene for prostate cancer which was obtained by determining the frequencies of the biallelic markers of FIG. 9 in affected and unaffected populations.

Association studies were run in two successive steps. In a first step, a rough localization of the candidate gene was achieved by determining the frequencies of the biallelic markers of FIG. 9 in the affected and unaffected populations. The results of this rough localization are shown in FIG. 10. This analysis indicated that a gene responsible for prostate cancer was located near the biallelic marker designated 4-67.

In a second phase of the analysis, the position of the gene responsible for prostate cancer was further refined using the very high density set of markers including the markers of SEQ ID Nos: 3915 to 3926 or the sequences complementary thereto (markers 99-123-381, 4-26-29, 4-14-240, 4-77-151, 99-217-277, 4-67-40, 99-213-164, 99-221-377, 99-135-196, 99-1482-32, 4-73-134, and 4-65-324).

Figure 11:
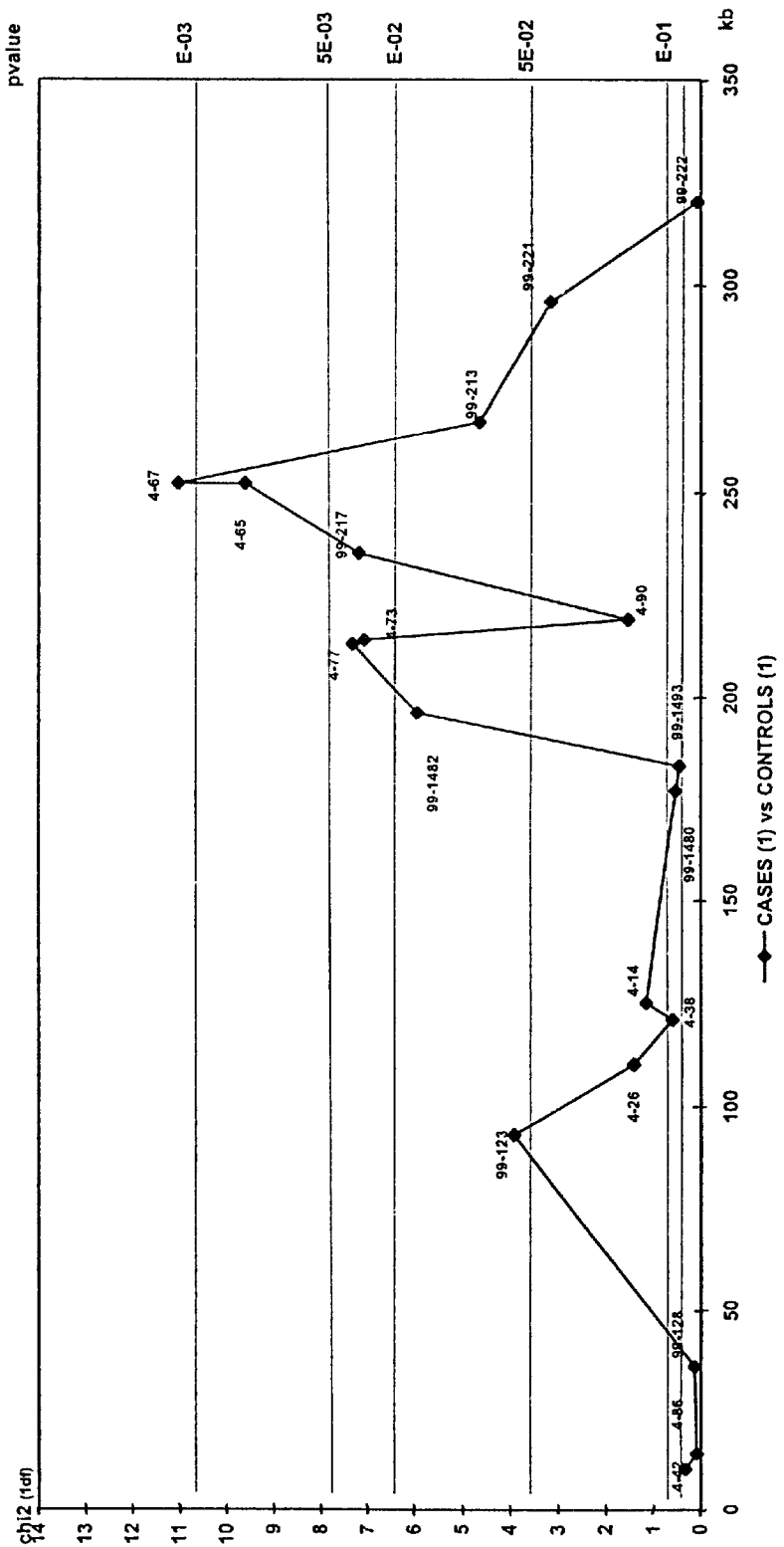
FIG. 11 is a further refinement of the localization of the candidate gene for prostate cancer using additional biallelic markers which were not included in the rough localization illustrated in FIG. 10.

As shown in FIG. 11, the second phase of the analysis confirmed that the gene responsible for prostate cancer was near the biallelic marker designated 4-67-40, most probably within a ca. 150 kb region comprising the marker.

A haplotype analysis was also performed as described in Example 15.

Example 15

Haplotype Analysis

The allelic frequencies of each of the alleles of biallelic markers 99-123-381, 4-26-29, 4-14-240, 4-77-151, 99-217-277, 4-67-40, 99-213-164, 99-221-377, and 99-135-196 were determined in the affected and unaffected populations. Table 4 lists the internal identification numbers of the markers used in the haplotype analysis (SEQ ID Nos: 3915–3923), the alleles of each marker, the most frequent allele in both unaffected individuals and individuals suffering from prostate cancer, the least frequent allele in both unaffected individuals and individuals suffering from prostate cancer, and the frequencies of the least frequent alleles in each population.

TABLE 4

| Markers | Polymorphic base * | Frequency of least frequent allele ** | |
|---|---|---|---|
| | | Cases | Controls |
| 99-123-381 | C/T | 0.35 | 0.3 |
| 4-26-29 | A/G | 0.39 | 0.45 |
| 4-14-240 | C/T | 0.35 | 0.41 |
| 4-77-151 | C/G | 0.33 | 0.24 |
| 99-217-277 | C/T | 0.31 | 0.23 |
| 4-67-40 | C/T | 0.26 | 0.16 |
| 99-213-164 | T/C | 0.45 | 0.38 |
| 99-221-377 | C/A | 0.43 | 0.43 |
| 99-135-196 | A/G | 0.25 | 0.3 |

\* most frequent allele/least frequent allele
\*\* standard deviations
0.023 to 0.031 for controls;
0.018 to 0.021 for cases Among all the theoretical potential different haplotypes based on 2 to 9 markers, 11 haplotypes showing a strong association with prostate cancer were selected. The results of these haplotype analyzes are shown in FIG. 12.

FIGS. 11 and 12 aggregate association analysis results with sequencing results—generated following the procedures further described in Example 16, which permitted the physical order and the distance between markers to be estimated.

The significance of the values obtained in FIG. 12 are underscored by the following results of computer simulations. For the computer simulations, the data from the affected individuals and the unaffected controls were pooled and randomly allocated to two groups which contained the same number of individuals as the affected and unaffected groups used to compile the data summarized in FIG. 12. A haplotype analysis was run on these artificial groups for the six markers included in haplotype 5 of FIG. 12. This experiment was reiterated 100 times and the results are shown in FIG. 13. Among 100 iterations, only 5% of the obtained haplotypes are present with a p-value less significant than E-04 as compared to the p-value of 9E-07 for haplotype 5 of FIG. 12. Furthermore, for haplotype 5 of FIG. 12, only 6% of the obtained haplotypes have a significance level below $5^{E-}03$, while none of them show a significance level below 5E-03.

Thus, using the data of FIG. 13 and evaluating the associations for single marker alleles or for haplotypes will permit estimation of the risk a corresponding carrier has to develop prostate cancer. It will be appreciated that significance thresholds of relative risks will be more finely assessed according to the population tested.

Diagnostic techniques for determining an individual's risk of developing prostate cancer may be implemented as described below for the markers in the maps of the present invention, including the markers of SEQ ID Nos: 3915 to 3923 (markers 99-123-381, 4-26-29, 4-14-240, 4-77-151, 99-217-277, 4-67-40, 99-213-164, 99-221-377, and 99-135-196).

The above haplotype analysis indicated that 171 kb of genomic DNA between biallelic markers 4-14-240 and 99-221-377 totally or partially contains a gene responsible for prostate cancer. Therefore, the protein coding sequences lying within this region were characterized to locate the gene associated with prostate cancer. This analysis, described in further detail below, revealed a single protein coding sequence in the 171 kb genomic region, which was designated as the PG1 gene.

Example 16

Identification of the Genomic Sequence in the Candidate Region

Template DNA for sequencing the PG1 gene was obtained as follows. BACs E and F from FIG. 9 were subcloned as previously described. Plasmid inserts were first amplified by PCR on PE 9600 thermocyclers (Perkin-Elmer), using appropriate primers, AmpliTaqGold (Perkin-Elmer), dNTms (Boehringer), buffer and cycling conditions as recommended by the Perkin-Elmer Corporation.

PCR products were then sequenced using automatic ABI Prism 377 sequencers (Perkin Elmer, Applied Biosystems Division, Foster City, Calif.). Sequencing reactions were performed using PE 9600 thermocyclers (Perkin Elmer) with standard dye-primer chemistry and ThermoSequenase (Amersham Life Science). The primers were labeled with the JOE, FAM, ROX and TAMRA dyes. The dNTPs and ddNTPs used in the sequencing reactions were purchased from Boehringer. Sequencing buffer, reagent concentrations and cycling conditions were as recommended by Amersham.

Following the sequencing reaction, the samples were precipitated with EtOH, resuspended in formamide loading buffer, and loaded on a standard 4% acrylamide gel. Electrophoresis was performed for 2.5 hours at 3000V on an ABI 377 sequencer, and the sequence data were collected and analyzed using the ABI Prism DNA Sequencing Analysis Software, version 2.1.2.

The sequence data obtained as described above were transferred to a proprietary database, where quality control and validation steps were performed. A proprietary base-caller flagged suspect peaks, taking into account the shape of the peaks, the inter-peak resolution, and the noise level. The proprietary base-caller also performed an automatic trimming. Any stretch of 25 or fewer bases having more than 4 suspect peaks was considered unreliable and was discarded.

The sequence fragments from BAC subclones isolated as described above were assembled using Gap4 software from R. Staden (Bonfield et al. 1995). This software allows the reconstruction of a single sequence from sequence fragments. The sequence deduced from the alignment of different fragments is called the consensus sequence. Directed sequencing techniques (primer walking) were used to complete sequences and link contigs.

Potential functional sequences were then identified as described in Example 17.

Example 17

Identification of Functional Sequences

Potential exons in BAC-derived human genomic sequences were located by homology searches on protein, nucleic acid and EST (Expressed Sequence Tags) public databases. Main public databases were locally reconstructed as mentioned in Example 9. The protein database, NRPU (Non-redundant Protein Unique) is formed by a non-redundant fusion of the Genpept (Benson et al., *Nucleic Acids Res*. 24:1–5 (1996), the disclosure of which is incorporated herein by reference in its entirety), Swissprot (Bairoch, A. and Apweiler, R., *Nucleic Acids Res*. 24:21–25 (1996), the disclosure of which is incorporated herein by reference in its entirety) and PIR/NBRF (George et al., *Nucleic Acids Res*. 24:17–20 (1996), the disclosure of which is incorporated herein by reference in its entirety) databases. Redundant data were eliminated by using the NRDB software (Benson et al. (1996), supra) and internal repeats were masked with the XNU software (Benson et al., supra). Homologies found using the NRPU database allowed the identification of sequences corresponding to potential coding exons related to known proteins.

The EST local database is composed by the gbest section (1-9) of GenBank (Benson et al. (1996), supra), and thus contains all publicly available transcript fragments. Homologies found with this database allowed the localization of potentially transcribed regions.

The local nucleic acid database contained all sections of GenBank and EMBL (Rodriguez-Tome et al., *Nucleic Acids Res*. 24:6–12 (1996), the disclosure of which is incorporated herein by reference in its entirety) except the EST sections. Redundant data were eliminated as previously described.

Similarity searches in protein or nucleic acid databases were performed using the BLAST software (Altschul et al., *J. Mol. Biol*. 215:403–410 (1990), the disclosure of which is incorporated herein by reference in its entirety). Alignments were refined using the Fasta software, and multiple alignments used Clustal W. Homology thresholds were adjusted for each analysis based on the length and the complexity of the tested region, as well as on the size of the reference database.

Potential exon sequences identified as above were used as probes to screen cDNA libraries. Extremities of positive clones were sequenced and the sequence stretches were positioned on the genomic sequence determined above. Primers were then designed using the results from these alignments in order to enable the cloning of cDNAs derived from the gene associated with prostate cancer that was identified using the above procedures.

The obtained cDNA molecules were then sequenced and results of Northern blot analysis of prostate mRNAs supported the existence of a major cDNA having a 5–6 kb length. The structure of the gene associated with prostate cancer was evaluated as described in Example 18.

Example 18

Analysis of Gene Structure

The intron/exon structure of the gene was finally completely deduced by aligning the mRNA sequence from the cDNA obtained as described above and the genomic DNA sequence obtained as described above. This alignment permitted the determination of the positions of the introns and exons, the positions of the start and end nucleotides defining each of the at least 8 exons, the locations and phases of the 5' and 3' splice sites, the position of the stop codon, and the position of the polyadenylation site to be determined in the genomic sequence. This analysis also yielded the positions of the coding region in the mRNA, and the locations of the polyadenylation signal and polyA stretch in the mRNA.

The gene identified as described above comprises at least 8 exons and spans more than 52 kb. A G/C rich putative promoter region was identified upstream of the coding sequence. A CCAAT in the putative promoter was also identified. The promoter region was identified as described in Prestridge, D. S., Predicting Pol II Promoter Sequences Using Transcription Factor Binding Sites, *J. Mol. Biol*. 249:923–932 (1995), the disclosure of which is incorporated herein by reference in its entirety.

Additional analysis using conventional techniques, such as a 5'RACE reaction using the Marathon-Ready human prostate cDNA kit from Clontech (Catalog. No. PT1156-1), may be performed to confirm that the 5' of the cDNA obtained above is the authentic 5' end in the mRNA.

Alternatively, the 5' sequence of the transcript can be determined by conducting a PCR amplification with a series of primers extending from the 5' end of the identified coding region.

Example 19

Detection of Biallelic Markers in the Candidate Gene: DNA Extraction

Donors were unrelated and healthy. They presented a sufficient diversity for being representative of a French heterogeneous population. The DNA from 100 individuals was extracted and tested for the detection of the biallelic markers.

30 ml of peripheral venous blood were taken from each donor in the presence of EDTA. Cells (pellet) were collected after centrifugation for 10 minutes at 2000 rpm. Red cells were lysed by a lysis solution (50 ml final volume: 10 mM Tris pH7.6; 5 mM $MgCl_{2;\ 10}$ mM NaCl). The solution was centrifuged (10 minutes, 2000 rpm) as many times as necessary to eliminate the residual red cells present in the supernatant, after resuspension of the pellet in the lysis solution.

The pellet of white cells was lysed overnight at 42° C. with 3.7 ml of lysis solution composed of:

3 ml TE 10-2 (Tris-HCl 10 mM, EDTA 2 mM)/NaCl 0.4 M

200 µl SDS 10%

500 µl K-proteinase (2 mg K-proteinase in TE 10-2/NaCl 0.4 M).

For the extraction of proteins, 1 ml saturated NaCl (6M) (1/3.5 v/v) was added. After vigorous agitation, the solution was centrifuged for 20 minutes at 10000 rpm. For the precipitation of DNA, 2 to 3 volumes of 100% ethanol were added to the previous supernatant, and the solution was centrifuged for 30 minutes at 2000 rpm. The DNA solution was rinsed three times with 70% ethanol to eliminate salts, and centrifuged for 20 minutes at 2000 rpm. The pellet was dried at 37° C., and resuspended in 1 ml TE 10-1 or 1 ml water. The DNA concentration was evaluated by measuring the OD at 260 nm (1 unit OD=50 µg/ml DNA).

To determine the presence of proteins in the DNA solution, the OD 260/OD 280 ratio was determined. Only DNA preparations having a OD 260/OD 280 ratio between 1.8 and 2 were used in the subsequent examples described below.

The pool was constituted by mixing equivalent quantities of DNA from each individual.

Example 20

Detection of the Biallelic Markers: Amplification of Genomic DNA by PCR

The amplification of specific genomic sequences of the DNA samples of Example 19 was carried out on the pool of DNA obtained previously using the amplification primers of SEQ ID Nos: 7861 to 7865 and 11792 to 11796. In addition, 50 individual samples were similarly amplified.

PCR assays were performed using the following protocol:

| | |
|---|---|
| Final volume | 25 µl |
| DNA | 2 ng/µl |
| MgCl2 | 2 mM |
| dNTP (each) | 200 µM |
| primer (each) | 2.9 ng/µl |
| Ampli Taq Gold DNA polymerase | 0.05 unit/µl |
| PCR buffer (10x = 0.1 M TrisHCl pH 8.3 0.5 M KCl | 1x |

Pairs of first primers were designed to amplify the promoter region, exons, and 3' end of the candidate asthma-associated gene using the sequence information of the candidate gene and the OSP software (Hillier & Green, 1991). These first primers were about 20 nucleotides in length and contained a common oligonucleotide tail upstream of the specific bases targeted for amplification which was useful for sequencing. The synthesis of these primers was performed following the phosphoramidite method, on a GENSET UFPS 24.1 synthesizer.

DNA amplification was performed on a Genius II thermocycler. After heating at 94° C. for 10 min, 40 cycles were performed. Each cycle comprised: 30 sec at 94° C., 55° C. for 1 min, and 30 sec at 72° C. For final elongation, 7 min at 72° C. ended the amplification. The quantities of the amplification products obtained were determined on 96-well microtiter plates, using a fluorometer and Picogreen as intercalant agent (Molecular Probes).

Example 21

Detection of the Biallelic Markers Sequencing of Amplified Genomic DNA and Identification of Polymorphisms The sequencing of the amplified DNA obtained in Example 20 was carried out on ABI 377 sequencers. The sequences of the amplification products were determined using automated dideoxy terminator sequencing reactions with a dye terminator cycle sequencing protocol. The products of the sequencing reactions were run on sequencing gels and the sequences were analyzed as formerly described.

The sequence data were further evaluated using the above mentioned polymorphism analysis software designed to detect the presence of biallelic markers among the pooled amplified fragments. The polymorphism search was based on the presence of superimposed peaks in the electrophoresis pattern resulting from different bases occurring at the same position as described previously.

Six fragments of amplification were analyzed. In these segments, 8 biallelic markers were detected (SEQ ID Nos: 3927 to 3934). The localization of the biallelic markers, the polymorphic bases of each allele, and the frequencies of the most frequent alleles was as shown in Table 5.

TABLE 5

| Amplicon | Marker Name | Origin of DNA | Localization gene | Polymorphism | Frequency |
|---|---|---|---|---|---|
| 1 | 10-204-326 | Ind. | Promoter | A/G | 96.2 (G) |
| 2 | 10-32-357 | Pool | Intron 1 | A/C | 67.7 (C) |
| 3 | 10-33-175 | Ind. | Exon 2 | C/T | 97.3 (C) |
| 3 | 10-33-234 | Pool | Intron 2 | A/C | 56.7 (C) |
| 3 | 10-33-327 | Ind. | Intron 2 | C/T | 75.3 (T) |
| 5 | 10-35-358 | Pool | Intron 4 | C/G | 67.9 (G) |
| 5 | 10-35-390 | Ind. | Intron 4 | C/T | 82 (C) |
| 6 | 10-36-164 | Ind. | Exon 5 | A/G | 99.5 (G) |

Allelic frequencies were determined in a population of random blood donors from French Caucasian origin. Their wide range is due to the fact that, besides screening a pool of 100 individuals to generate biallelic markers as described above, polymorphism searches were also conducted in an individual testing format for 50 samples. This strategy was chosen here to provide a potential shortcut towards the identification of putative causal mutations in the association studies using them. As the 10-36-164 biallelic marker (SEQ ID No: 3933) was found in only one individual, this marker was not considered in the association studies.

The fourth fragment of amplification carrying exon 3 (not shown in the Table) was not polymorphic in the tested samples (1 pool+50 individuals).

Example 22

Validation of the Polymorphisms Through Microsequencing

The biallelic markers identified in Example 21 were further confirmed and their respective frequencies were determined through microsequencing. Microsequencing was carried out for each individual DNA sample described in Example 19.

Amplification from genomic DNA of individuals was performed by PCR as described above for the detection of the biallelic markers with the same set of PCR primers described above.

The preferred primers used in microsequencing had about 19 nucleotides in length and hybridized just upstream of the considered polymorphic base. Five primers hybridized with the non-coding strand of the gene. For the biallelic markers 10-204-326, 10-35-358 and 10-36-164, primers hybridized with the coding strand of the gene.

The microsequencing reaction was performed as described in Example 13.

Example 23

Association Study Between Asthma and the Biallelic Markers of the Candidate Gene Collection of DNA Samples from Affected and Non-Affected Individuals The asthmatic population used to perform association studies in order to establish whether the candidate gene was an asthma-causing gene consisted of 298 individuals. More than 90% of these 298 asthmatic individuals had a Caucasian ethnic background.

The control population consisted of 373 unaffected individuals, among which 279 French (at least 70% were of Caucasian origin) and 94 American (at least 90% were of Caucasian origin).

DNA samples were obtained from asthmatic and non-asthmatic individuals as described above.

Example 24

Association Study Between Asthma and the Biallelic Markers of the Candidate Gene Genotyping of Affected and Control Individuals The general strategy to perform the association studies was to individually scan the DNA samples from all individuals in each of the populations described above in order to establish the allele frequencies of the above described biallelic markers in each of these populations.

Allelic frequencies of the above-described biallelic markers in each population were determined by performing microsequencing reactions on amplified fragments obtained by genomic PCR performed on the DNA samples from each individual. Genomic PCR and microsequencing were performed as detailed above in Examples 20 and 22 using the described amplification and microsequencing primers.

Example 25

Association study Between Asthma and the Biallelic Markers of the Candidate Gene Table 6 shows the results of the association study between five biallelic markers in the candidate gene and asthma.

TABLE 6

| | Allelic frequencies (%) | | | |
|---|---|---|---|---|
| Markers | Asthmatics 298 individuals | Controls 373 individuals | Frequency diff. | P value |
| 10-32-357 | A 38.6 | A 29.8 | 8.8 | $7.34 \times 10^{-4}$ |
| 10-33-234 | A 49 | A 44.3 | 4.7 | $8.86 \times 10^{-2}$ |
| 10-33-327 | T 78.5 | T 74.6 | 3.9 | $1.0 \times 10^{-1}$ |
| 10-35-358 | G 72.3 | G 66.9 | 5.4 | $3.59 \times 10^{-2}$ |
| 10-35-390 | T 30.4 | T 20.3 | 10.1 | $2.33 \times 10^{-5}$ |

As shown in Table 6, markers 10-32-357 and 10-35-390 presented a strong association with asthma, this association being highly significant (p value=$7.34 \times 10^{-4}$ for marker 10-32-357 and $2.33 \times 10^{-5}$ for marker 10-35-390).

Three markers showed moderate association when tested independently, namely 10-33-234, 10-33-327,10–35-358.

It is worth mentioning that allelic frequencies for each of the biallelic markers of Table 7 were separately measured within the French control population (279 individuals) and the American control population (94 individuals). The differences in allele frequencies between the two populations were between 1% and 7%, with p-values above 10-1. These data confirmed that the combined French/American control population (373 individuals) was homogeneous enough to be used as a control population for the present association study.

Example 26

Association Studies: Haplotype Frequency Analysis

As already shown, one way of increasing the statistical power of individual markers, is by performing haplotype association analysis. A haplotype analysis for association of markers in the candidate gene and asthma was performed by estimating the frequencies of all possible haplotypes for biallelic markers 10-32-357, 10-33-234, 10-33-327, 10-35-358 and 10-35-390 in the asthmatic and control populations described in Example 25 (Table 6), and comparing these frequencies by means of a chi square statistical test (one degree of freedom). Haplotype estimations were performed by applying the Expectation-Maximization (EM) algorithm (Excoffier L & Slatkin M, 1995, *Mol.Biol.Evol.* 12:921–927, the disclosure of which is incorporated herein by reference in its entirety), using the EM-HAPLO program (Hawley Ma., Pakstis A J & Kidd K K, 1994, Am.J.Phys.Anthropol. 18:104, the disclosure of which is incorporated herein by reference in its entirety).

The results of such haplotype analysis are shown in Table 7.

TABLE 7

| | Haplotype frequencies | | | | | | | | |
|---|---|---|---|---|---|---|---|---|---|
| Markers | 10-32-357 | 10-33-234 | 10-33-327 | 10-35-358 | 10-35-390 | Asthm. | Controls | Odds ratio | P value |
| Frequency diff. | 8.8 | 4.7 | 3.9 | 5.4 | 10.1 | | | | |
| P value | $7.34 \times 10^{-4}$ | $8.86 \times 10^{-2}$ | $1.0 \times 10^{-1}$ | $3.59 \times 10^{-2}$ | $2.33 \times 10^{-5}$ | | | | |
| Haplotype 1 5 | A | T | | | | 0.2 | 0.11 | 2.02 | $8.47 \times 10^{-6}$ |
| Haplotype 2 | A | T | G | | | 0.27 | 0.18 | 1.68 | $2.81 \times 10^{-4}$ |
| Haplotype 3 | A | A | T | G | T | 0.18 | 0.09 | 2.22 | $3.95 \times 10^{-5}$ |

A two-marker haplotype covering markers 10-32-357 and 10-35-390 (haplotype 1, AT alleles respectively) presented a p value of $8.47 \times 10-6$, an odds ratio of 2.02 and haplotype frequencies of 0.2 for asthmatic and 0.11 for control populations respectively.

A three-marker haplotype covering markers 10-33-234, 10-33-327 and 10-35-358 (haplotype 2, ATG alleles respectively) presented a p value of $2.81 \times 10-4$, an odds ratio of 1.68 and haplotype frequencies of 0.27 for asthmatic and 0.18 for control populations respectively.

A five-marker haplotype covering markers 10-32-357, 10-33-234, 10-33-327, 10-35-358 and 10-35-390 (haplotype 3, AATGT alleles respectively) presented a p value of $3.95 \times 10-5$, an odds ratio of 2.22 and haplotype frequencies of 0.18 for asthmatic and 0.09 for control populations respectively.

Haplotype association analysis thus increased the statistical power of the individual marker association studies when compared to single-marker analysis (from p values between $10^{-1}$ and $2 \times 10^{-5}$ for the individual markers to p values between $3 \times 10^{-4}$ and $8 \times 10^{-6}$ for the three-marker haplotype, haplotype 2).

The significance of the values obtained for the haplotype association analysis was evaluated by the following computer simulation test. The genotype data from the asthmatic and control individuals were pooled and randomly allocated to two groups which contained the same number of individuals as the trait-positive and trait-negative groups used to produce the data summarized in Table 7. A haplotype analysis was then run on these artificial groups for the three haplotypes presented in Table 6. This experiment was reiterated 1000 times and the results are shown in Table 8.

TABLE 8

| Haplotype | Chi-Square Average | Chi-Square | Permutation Test Maximal Chi-Square | P value |
|---|---|---|---|---|
| Haplotype 1 (A---T) | 19.70 | 1.2 | 11.6 | $1.0 \times 10^{-3}$ |
| Haplotype 2 (-ATG-) | 13.49 | 1.2 | 10.5 | $1.0 \times 10^{-3}$ |
| Haplotype 3 (AATGT) | 16.66 | 1.2 | 9.3 | $1.0 \times 10^{-3}$ |

The results in Table 8 show that among 1000 iterations only 1‰ of the obtained haplotypes has a p value comparable to the one obtained in Table 4.

These results clearly validate the statistical significance of the haplotypes obtained (haplotypes 1, 2 and 3, Table 7).

Example 27

Extraction of DNA 30 ml of blood are taken from the individuals in the presence of EDTA. Cells (pellet) are collected after centrifugation for 10 minutes at 2000 rpm. Red cells are lysed by a lysis solution (50 ml final volume: 10 mM Tris pH7.6; 5 mM MgCl$_2$; 10 mM NaCl). The solution is centrifuged (10 minutes, 2000 rpm) as many times as necessary to eliminate the residual red cells present in the supernatant, after resuspension of the pellet in the lysis solution.

The pellet of white cells is lysed overnight at 42° C. with 3.7 ml of lysis solution composed of:

3 ml TE 10-2 (Tris-HCl 10 mM, EDTA 2 mM)/NaCl 0.4 M

200 µl SDS 10%

500 µl K-proteinase (2 mg K-proteinase in TE 10-2/NaCl 0.4 M).

For the extraction of proteins, 1 ml saturated NaCl (6M) (1/3.5 v/v) is added. After vigorous agitation, the solution is centrifuged for 20 minutes at 10000 rpm. For the precipitation of DNA, 2 to 3 volumes of 100% ethanol are added to the previous supernatant, and the solution is centrifuged for 30 minutes at 2000 rpm. The DNA solution is rinsed three times with 70% ethanol to eliminate salts, and centrifuged for 20 minutes at 2000 rpm. The pellet is dried at 37° C., and resuspended in 1 ml TE 10-1 or 1 ml water. The DNA concentration is evaluated by measuring the OD at 260 nm (1 unit OD=50 µg/ml DNA).

To evaluate the presence of proteins in the DNA solution, the OD 260/OD 280 ratio is determined. Only DNA preparations having a OD 260/OD 280 ratio between 1.8 and 2 are used in the subsequent steps described below.

Once genomic DNA from every individual in the given population has been extracted, it is preferred that a fraction of each DNA sample is separated, after which a pool of DNA is constituted by assembling equivalent DNA amounts of the separated fractions into a single one.

Although this invention has been described in terms of certain preferred embodiments, other embodiments which will be apparent to those of ordinary skill in the art of view of the disclosure herein are also within the scope of this invention. Accordingly, the scope of the invention is intended to be defined only by reference to the appended claims.

TABLE 1

| SEQ ID No. | Marker Name | Allele 1$^{ST}$ | Allele 2$^{ND}$ | Preferred microseq. primer | Amplification primer Upstream (PU) | Amplification primer Downstream (RP) |
|---|---|---|---|---|---|---|
| 1 | 99-109-224 | G | C | S | 3935 | 7866 |
| 2 | 99-1126-384 | A | G | S | 3936 | 7867 |
| 3 | 99-114-68 | G | C | S | 3937 | 7868 |
| 4 | 99-1151-516 | A | C | S | 3938 | 7869 |
| 5 | 99-1165-159 | C | T | S | 3939 | 7870 |
| 6 | 99-1167-201 | A | G | A | 3940 | 7871 |
| 7 | 99-117-205 | C | T | S | 3941 | 7872 |
| 8 | 99-118-92 | C | T | S | 3942 | 7873 |
| 9 | 99-1217-332 | C | T | A | 3943 | 7874 |
| 10 | 99-1233-183 | A | G | S | 3944 | 7875 |
| 11 | 99-12478-263 | G | T | A | 3945 | 7876 |
| 12 | 99-12487-301 | A | C | S | 3946 | 7877 |
| 13 | 99-12497-155 | C | T | S | 3947 | 7878 |
| 14 | 99-12503-44 | G | C | S | 3948 | 7879 |
| 15 | 99-12504-402 | A | T | S | 3949 | 7880 |
| 16 | 99-12505-374 | A | G | A | 3950 | 7881 |
| 17 | 99-12506-199 | G | T | A | 3951 | 7882 |
| 18 | 99-12509-423 | C | T | S | 3952 | 7883 |
| 19 | 99-12513-146 | G | C | S | 3953 | 7884 |
| 20 | 99-12514-170 | G | C | S | 3954 | 7885 |
| 21 | 99-12515-205 | G | C | S | 3955 | 7886 |
| 22 | 99-12516-524 | A | G | A | 3956 | 7887 |
| 23 | 99-12518-325 | C | T | S | 3957 | 7888 |
| 24 | 99-12523-255 | C | T | S | 3958 | 7889 |
| 25 | 99-12525-277 | C | T | S | 3959 | 7890 |
| 26 | 99-12526-317 | C | T | S | 3960 | 7891 |
| 27 | 99-12527-292 | A | G | A | 3961 | 7892 |
| 28 | 99-12531-30 | C | T | S | 3962 | 7893 |
| 29 | 99-12532-199 | A | T | S | 3963 | 7894 |
| 30 | 99-12534-207 | A | C | S | 3964 | 7895 |
| 31 | 99-12535-362 | A | C | S | 3965 | 7896 |
| 32 | 99-12537-340 | G | C | S | 3966 | 7897 |
| 33 | 99-12538-142 | A | C | S | 3967 | 7898 |
| 34 | 99-12539-287 | C | T | S | 3968 | 7899 |
| 35 | 99-12540-426 | C | T | S | 3969 | 7900 |

TABLE 1-continued

| SEQ ID No. | Marker Name | Preferred Allele 1ST | 2ND | microseq. primer | Amplification primer Upstream (PU) | Downstream (RP) |
|---|---|---|---|---|---|---|
| 36 | 99-12541-307 | C | T | S | 3970 | 7901 |
| 37 | 99-12545-121 | A | G | A | 3971 | 7902 |
| 38 | 99-12548-88 | A | G | A | 3972 | 7903 |
| 39 | 99-12558-167 | C | T | S | 3973 | 7904 |
| 40 | 99-12562-291 | C | T | S | 3974 | 7905 |
| 41 | 99-12564-354 | A | T | S | 3975 | 7906 |
| 42 | 99-12565-273 | C | T | S | 3976 | 7907 |
| 43 | 99-12575-248 | G | C | S | 3977 | 7908 |
| 44 | 99-12576-325 | C | T | S | 3978 | 7909 |
| 45 | 99-12580-268 | A | G | A | 3979 | 7910 |
| 46 | 99-12585-85 | A | C | S | 3980 | 7911 |
| 47 | 99-12593-103 | A | C | S | 3981 | 7912 |
| 48 | 99-12600-283 | G | C | S | 3982 | 7913 |
| 49 | 99-12608-71 | C | T | S | 3983 | 7914 |
| 50 | 99-12610-106 | C | T | S | 3984 | 7915 |
| 51 | 99-12611-311 | G | T | A | 3985 | 7916 |
| 52 | 99-12613-366 | A | G | A | 3986 | 7917 |
| 53 | 99-12615-235 | A | C | S | 3987 | 7918 |
| 54 | 99-12617-412 | G | C | S | 3988 | 7919 |
| 55 | 99-12618-211 | C | T | S | 3989 | 7920 |
| 56 | 99-12619-367 | A | G | A | 3990 | 7921 |
| 57 | 99-12621-114 | A | G | A | 3991 | 7922 |
| 58 | 99-12624-61 | A | T | S | 3992 | 7923 |
| 59 | 99-1263-276 | A | G | S | 3993 | 7924 |
| 60 | 99-12632-165 | C | T | S | 3994 | 7925 |
| 61 | 99-12637-62 | C | T | S | 3995 | 7926 |
| 62 | 99-12639-311 | G | C | S | 3996 | 7927 |
| 63 | 99-12640-179 | C | T | A | 3997 | 7928 |
| 64 | 99-12650-200 | C | T | A | 3998 | 7929 |
| 65 | 99-12651-297 | G | C | S | 3999 | 7930 |
| 66 | 99-12652-459 | A | G | S | 4000 | 7931 |
| 67 | 99-12654-278 | G | T | A | 4001 | 7932 |
| 68 | 99-12656-303 | C | T | A | 4002 | 7933 |
| 69 | 99-12658-206 | A | G | A | 4003 | 7934 |
| 70 | 99-12661-92 | G | T | A | 4004 | 7935 |
| 71 | 99-12668-329 | C | T | A | 4005 | 7936 |
| 72 | 99-1268-177 | A | G | A | 4006 | 7937 |
| 73 | 99-12733-366 | G | C | S | 4007 | 7938 |
| 74 | 99-12738-57 | G | C | S | 4008 | 7939 |
| 75 | 99-12740-354 | C | T | A | 4009 | 7940 |
| 76 | 99-12749-286 | A | G | S | 4010 | 7941 |
| 77 | 99-12750-369 | A | T | S | 4011 | 7942 |
| 78 | 99-12751-406 | C | T | A | 4012 | 7943 |
| 79 | 99-12755-421 | A | G | S | 4013 | 7944 |
| 80 | 99-12756-344 | A | C | S | 4014 | 7945 |
| 81 | 99-12757-240 | A | G | S | 4015 | 7946 |
| 82 | 99-12759-420 | G | T | A | 4016 | 7947 |
| 83 | 99-12777-71 | A | G | S | 4017 | 7948 |
| 84 | 99-12782-76 | A | C | S | 4018 | 7949 |
| 85 | 99-12794-299 | G | C | S | 4019 | 7950 |
| 86 | 99-128-60 | C | T | S | 4020 | 7951 |
| 87 | 99-12816-101 | G | C | S | 4021 | 7952 |
| 88 | 99-12817-358 | C | T | A | 4022 | 7953 |
| 89 | 99-12819-165 | A | G | S | 4023 | 7954 |
| 90 | 99-12826-408 | A | T | S | 4024 | 7955 |
| 91 | 99-12831-345 | A | C | S | 4025 | 7956 |
| 92 | 99-12836-387 | C | T | A | 4026 | 7957 |
| 93 | 99-12842-305 | C | T | A | 4027 | 7958 |
| 94 | 99-12843-337 | A | G | S | 4028 | 7959 |
| 95 | 99-12844-130 | A | G | S | 4029 | 7960 |
| 96 | 99-12847-37 | A | G | S | 4030 | 7961 |
| 97 | 99-12848-204 | A | G | S | 4031 | 7962 |
| 98 | 99-12852-260 | A | G | S | 4032 | 7963 |
| 99 | 99-12856-183 | A | C | S | 4033 | 7964 |
| 100 | 99-12878-291 | C | T | S | 4034 | 7965 |
| 101 | 99-12880-282 | C | T | S | 4035 | 7966 |
| 102 | 99-12884-248 | A | G | A | 4036 | 7967 |
| 103 | 99-12885-261 | A | C | S | 4037 | 7968 |
| 104 | 99-12898-364 | C | T | S | 4038 | 7969 |
| 105 | 99-12899-307 | C | T | S | 4039 | 7970 |
| 106 | 99-1290-291 | C | T | S | 4040 | 7971 |
| 107 | 99-12900-165 | G | C | S | 4041 | 7972 |
| 108 | 99-12901-316 | A | G | A | 4042 | 7973 |
| 109 | 99-12903-381 | C | T | S | 4043 | 7974 |
| 110 | 99-12907-295 | A | G | A | 4044 | 7975 |
| 111 | 99-12908-369 | G | C | S | 4045 | 7976 |
| 112 | 99-12913-197 | C | T | S | 4046 | 7977 |
| 113 | 99-12914-227 | G | T | A | 4047 | 7978 |
| 114 | 99-12924-273 | G | C | S | 4048 | 7979 |
| 115 | 99-12925487 | C | T | S | 4049 | 7980 |
| 116 | 99-12926-332 | C | T | A | 4050 | 7981 |
| 117 | 99-12931-173 | A | G | S | 4051 | 7982 |
| 118 | 99-12948-61 | A | T | S | 4052 | 7983 |
| 119 | 99-12952-199 | G | C | S | 4053 | 7984 |
| 120 | 99-12956-43 | C | T | A | 4054 | 7985 |
| 121 | 99-12957-448 | C | T | A | 4055 | 7986 |
| 122 | 99-12961-318 | A | G | S | 4056 | 7987 |
| 123 | 99-12962-181 | A | G | S | 4057 | 7988 |
| 124 | 99-12963-255 | C | T | A | 4058 | 7989 |
| 125 | 99-12964-230 | C | T | A | 4059 | 7990 |
| 126 | 99-13021-124 | C | T | S | 4060 | 7991 |
| 127 | 99-13036-313 | A | C | S | 4061 | 7992 |
| 128 | 99-13045-385 | A | C | S | 4062 | 7993 |
| 129 | 99-13051-235 | A | G | S | 4063 | 7994 |
| 130 | 99-13061-100 | C | T | S | 4064 | 7995 |
| 131 | 99-13064-328 | C | T | S | 4065 | 7996 |
| 132 | 99-13065-311 | C | T | S | 4066 | 7997 |
| 133 | 99-13070-207 | G | T | A | 4067 | 7998 |
| 134 | 99-13098-369 | A | G | S | 4068 | 7999 |
| 135 | 99-13106-251 | A | G | S | 4069 | 8000 |
| 136 | 99-13115-106 | C | T | A | 4070 | 8001 |
| 137 | 99-13121-198 | A | G | S | 4071 | 8002 |
| 138 | 99-13130-75 | A | G | S | 4072 | 8003 |
| 139 | 99-13133-341 | A | G | S | 4073 | 8004 |
| 140 | 99-13134-79 | A | G | S | 4074 | 8005 |
| 141 | 99-13165-216 | A | G | S | 4075 | 8006 |
| 142 | 99-13178-252 | C | T | A | 4076 | 8007 |
| 143 | 99-13192-272 | A | G | S | 4077 | 8008 |
| 144 | 99-13193-453 | C | T | A | 4078 | 8009 |
| 145 | 99-13201-154 | C | T | A | 4079 | 8010 |
| 146 | 99-13213-79 | A | G | S | 4080 | 8011 |
| 147 | 99-13215-109 | C | T | A | 4081 | 8012 |
| 148 | 99-13218-103 | G | C | S | 4082 | 8013 |
| 149 | 99-13219-378 | A | G | S | 4083 | 8014 |
| 150 | 99-13222-274 | C | T | A | 4084 | 8015 |
| 151 | 99-13224-351 | C | T | S | 4085 | 8016 |
| 152 | 99-13227-270 | A | C | S | 4086 | 8017 |
| 153 | 99-13229-192 | G | T | A | 4087 | 8018 |
| 154 | 99-13232-494 | G | C | S | 4088 | 8019 |
| 155 | 99-13237-44 | G | T | S | 4089 | 8020 |
| 156 | 99-13238-276 | A | G | S | 4090 | 8021 |
| 157 | 99-13241-49 | C | T | A | 4091 | 8022 |
| 158 | 99-13246-251 | A | G | S | 4092 | 8023 |
| 159 | 99-13250-439 | C | T | A | 4093 | 8024 |
| 160 | 99-13251-118 | G | T | A | 4094 | 8025 |
| 161 | 99-13258-232 | G | T | A | 4095 | 8026 |
| 162 | 99-13260-358 | G | C | S | 4096 | 8027 |
| 163 | 99-13262-376 | G | C | S | 4097 | 8028 |
| 164 | 99-13269-144 | A | G | S | 4098 | 8029 |
| 165 | 99-13270-309 | G | T | A | 4099 | 8030 |
| 166 | 99-13271-163 | A | G | S | 4100 | 8031 |
| 167 | 99-13272-151 | A | G | S | 4101 | 8032 |
| 168 | 99-13273-144 | A | C | S | 4102 | 8033 |
| 169 | 99-13276-168 | C | T | A | 4103 | 8034 |
| 170 | 99-13279-301 | A | G | S | 4104 | 8035 |
| 171 | 99-13286-58 | A | G | S | 4105 | 8036 |
| 172 | 99-13287-298 | C | T | A | 4106 | 8037 |
| 173 | 99-13294-281 | A | G | S | 4107 | 8038 |
| 174 | 99-13296-330 | C | T | A | 4108 | 8039 |
| 175 | 99-13320-352 | A | G | S | 4109 | 8040 |
| 176 | 99-13332-259 | C | T | A | 4110 | 8041 |
| 177 | 99-13334-136 | A | C | S | 4111 | 8042 |
| 178 | 99-13336-364 | A | G | S | 4112 | 8043 |
| 179 | 99-13339-335 | G | C | S | 4113 | 8044 |
| 180 | 99-13354-225 | A | G | S | 4114 | 8045 |
| 181 | 99-13368-221 | C | T | A | 4115 | 8046 |

TABLE 1-continued

| SEQ ID No. | Marker Name | Allele 1ST | Allele 2ND | Preferred microseq. primer | Amplification primer Upstream (PU) | Amplification primer Downstream (RP) |
|---|---|---|---|---|---|---|
| 182 | 99-13394-42 | A | G | S | 4116 | 8047 |
| 183 | 99-13395-110 | C | T | A | 4117 | 8048 |
| 184 | 99-13396-258 | G | C | S | 4118 | 8049 |
| 185 | 99-134-362 | G | T | A | 4119 | 8050 |
| 186 | 99-13401-106 | A | C | A | 4120 | 8051 |
| 187 | 99-13404-373 | A | G | S | 4121 | 8052 |
| 188 | 99-13406-279 | G | T | A | 4122 | 8053 |
| 189 | 99-1342-51 | C | T | A | 4123 | 8054 |
| 190 | 99-13429-188 | A | C | S | 4124 | 8055 |
| 191 | 99-13439-327 | A | G | S | 4125 | 8056 |
| 192 | 99-13443-275 | C | T | A | 4126 | 8057 |
| 193 | 99-13450-276 | A | G | S | 4127 | 8058 |
| 194 | 99-13457-138 | G | C | S | 4128 | 8059 |
| 195 | 99-1346-503 | C | T | S | 4129 | 8060 |
| 196 | 99-13462-263 | A | G | S | 4130 | 8061 |
| 197 | 99-13486-358 | A | G | S | 4131 | 8062 |
| 198 | 99-13489-396 | C | T | A | 4132 | 8063 |
| 199 | 99-13499-445 | A | G | S | 4133 | 8064 |
| 200 | 99-13502-118 | C | T | S | 4134 | 8065 |
| 201 | 99-13509-388 | A | G | A | 4135 | 8066 |
| 202 | 99-1351-264 | A | T | S | 4136 | 8067 |
| 203 | 99-13515-428 | C | T | S | 4137 | 8068 |
| 204 | 99-13525-395 | C | T | S | 4138 | 8069 |
| 205 | 99-13526-368 | C | T | S | 4139 | 8070 |
| 206 | 99-13531-449 | A | T | S | 4140 | 8071 |
| 207 | 99-13536-134 | C | T | S | 4141 | 8072 |
| 208 | 99-13540-338 | G | C | S | 4142 | 8073 |
| 209 | 99-13541-85 | A | G | A | 4143 | 8074 |
| 210 | 99-13545-215 | C | T | S | 4144 | 8075 |
| 211 | 99-13552-172 | A | C | S | 4145 | 8076 |
| 212 | 99-13553-390 | A | C | S | 4146 | 8077 |
| 213 | 99-13555-402 | A | G | A | 4147 | 8078 |
| 214 | 99-1356-500 | A | T | S | 4148 | 8079 |
| 215 | 99-13567-258 | C | T | S | 4149 | 8080 |
| 216 | 99-13586-230 | G | T | A | 4150 | 8081 |
| 217 | 99-13588-238 | A | C | S | 4151 | 8082 |
| 218 | 99-13589-362 | A | G | A | 4152 | 8083 |
| 219 | 99-1359-355 | C | T | S | 4153 | 8084 |
| 220 | 99-13591-360 | G | C | S | 4154 | 8085 |
| 221 | 99-13592-304 | A | C | S | 4155 | 8086 |
| 222 | 99-13596-69 | A | C | S | 4156 | 8087 |
| 223 | 99-13598-260 | G | C | S | 4157 | 8088 |
| 224 | 99-13600-305 | A | G | S | 4158 | 8089 |
| 225 | 99-13601-360 | A | G | S | 4159 | 8090 |
| 226 | 99-13605-208 | C | T | A | 4160 | 8091 |
| 227 | 99-13606-83 | G | C | S | 4161 | 8092 |
| 228 | 99-1362-126 | A | G | A | 4162 | 8093 |
| 229 | 99-13624-415 | C | T | A | 4163 | 8094 |
| 230 | 99-13638-354 | A | G | S | 4164 | 8095 |
| 231 | 99-13644-439 | G | C | S | 4165 | 8096 |
| 232 | 99-13647-278 | C | T | A | 4166 | 8097 |
| 233 | 99-13652-407 | G | C | S | 4167 | 8098 |
| 234 | 99-13663-218 | C | T | A | 4168 | 8099 |
| 235 | 99-13666-275 | A | T | S | 4169 | 8100 |
| 236 | 99-1367-287 | A | G | A | 4170 | 8101 |
| 237 | 99-13671-396 | C | T | A | 4171 | 8102 |
| 238 | 99-13678-251 | C | T | A | 4172 | 8103 |
| 239 | 99-13679-285 | C | T | A | 4173 | 8104 |
| 240 | 99-1368-299 | C | T | S | 4174 | 8105 |
| 241 | 99-13684-488 | A | C | S | 4175 | 8106 |
| 242 | 99-13687-316 | A | G | S | 4176 | 8107 |
| 243 | 99-1373-358 | A | T | S | 4177 | 8108 |
| 244 | 99-1376-196 | A | T | S | 4178 | 8109 |
| 245 | 99-13790-129 | C | T | A | 4179 | 8110 |
| 246 | 99-13798-284 | A | G | S | 4180 | 8111 |
| 247 | 99-13831-102 | A | G | S | 4181 | 8112 |
| 248 | 99-13832-226 | C | T | A | 4182 | 8113 |
| 249 | 99-13835-39 | G | C | S | 4183 | 8114 |
| 250 | 99-1385-91 | G | C | A | 4184 | 8115 |
| 251 | 99-13853-256 | C | T | A | 4185 | 8116 |
| 252 | 99-13854-363 | C | T | A | 4186 | 8117 |
| 253 | 99-13860-368 | C | T | A | 4187 | 8118 |
| 254 | 99-13861-227 | A | G | S | 4188 | 8119 |
| 255 | 99-13866-198 | C | T | A | 4189 | 8120 |
| 256 | 99-13868-240 | C | T | A | 4190 | 8121 |
| 257 | 99-1387-462 | C | T | A | 4191 | 8122 |
| 258 | 99-13876-55 | A | G | S | 4192 | 8123 |
| 259 | 99-13878-385 | A | C | S | 4193 | 8124 |
| 260 | 99-1388-242 | A | G | A | 4194 | 8125 |
| 261 | 99-13880-185 | A | G | S | 4195 | 8126 |
| 262 | 99-13883-103 | A | G | S | 4196 | 8127 |
| 263 | 99-13887-190 | C | T | A | 4197 | 8128 |
| 264 | 99-13888-332 | C | T | A | 4198 | 8129 |
| 265 | 99-13892-338 | A | G | S | 4199 | 8130 |
| 266 | 99-13897-431 | G | T | A | 4200 | 8131 |
| 267 | 99-1391-204 | C | T | S | 4201 | 8132 |
| 268 | 99-13912-89 | C | T | A | 4202 | 8133 |
| 269 | 99-13913-278 | A | G | S | 4203 | 8134 |
| 270 | 99-13914-169 | A | G | S | 4204 | 8135 |
| 271 | 99-1392-200 | C | T | S | 4205 | 8136 |
| 272 | 99-13920-172 | A | G | S | 4206 | 8137 |
| 273 | 99-13925-97 | A | G | S | 4207 | 8138 |
| 274 | 99-13929-201 | A | C | S | 4208 | 8139 |
| 275 | 99-13932-229 | C | T | A | 4209 | 8140 |
| 276 | 99-1394-271 | A | G | A | 4210 | 8141 |
| 277 | 99-13956-119 | G | C | S | 4211 | 8142 |
| 278 | 99-13960-142 | C | T | A | 4212 | 8143 |
| 279 | 99-13962-339 | A | G | S | 4213 | 8144 |
| 280 | 99-13980-150 | C | T | A | 4214 | 8145 |
| 281 | 99-13996-123 | A | G | S | 4215 | 8146 |
| 282 | 99-13997-181 | C | T | A | 4216 | 8147 |
| 283 | 99-13998-421 | C | T | A | 4217 | 8148 |
| 284 | 99-140-130 | C | T | S | 4218 | 8149 |
| 285 | 99-14004-328 | G | C | S | 4219 | 8150 |
| 286 | 99-14005-344 | C | T | A | 4220 | 8151 |
| 287 | 99-14009-133 | C | T | A | 4221 | 8152 |
| 288 | 99-14010-165 | C | T | A | 4222 | 8153 |
| 289 | 99-14013-125 | C | T | A | 4223 | 8154 |
| 290 | 99-14025-459 | A | G | S | 4224 | 8155 |
| 291 | 99-1404-135 | A | G | S | 4225 | 8156 |
| 292 | 99-14046-270 | A | G | S | 4226 | 8157 |
| 293 | 99-14050-295 | G | T | A | 4227 | 8158 |
| 294 | 99-14068-214 | C | T | A | 4228 | 8159 |
| 295 | 99-14072-363 | C | T | A | 4229 | 8160 |
| 296 | 99-14080-436 | G | T | A | 4230 | 8161 |
| 297 | 99-14083-346 | A | G | S | 4231 | 8162 |
| 298 | 99-14087-429 | G | T | A | 4232 | 8163 |
| 299 | 99-14090-398 | A | T | S | 4233 | 8164 |
| 300 | 99-14094-274 | A | T | S | 4234 | 8165 |
| 301 | 99-14119-101 | C | T | S | 4235 | 8166 |
| 302 | 99-14120-283 | A | G | A | 4236 | 8167 |
| 303 | 99-14127-127 | A | G | A | 4237 | 8168 |
| 304 | 99-1413-137 | G | C | S | 4238 | 8169 |
| 305 | 99-14135-375 | C | T | S | 4239 | 8170 |
| 306 | 99-14139-321 | A | T | S | 4240 | 8171 |
| 307 | 99-14140-310 | A | G | A | 4241 | 8172 |
| 308 | 99-14145-220 | G | C | S | 4242 | 8173 |
| 309 | 99-14147-369 | A | G | A | 4243 | 8174 |
| 310 | 99-14149-351 | G | C | S | 4244 | 8175 |
| 311 | 99-1416-589 | A | G | A | 4245 | 8176 |
| 312 | 99-14161-267 | A | G | A | 4246 | 8177 |
| 313 | 99-14162-180 | C | T | S | 4247 | 8178 |
| 314 | 99-14166-217 | G | C | S | 4248 | 8179 |
| 315 | 99-14175-380 | A | G | S | 4249 | 8180 |
| 316 | 99-14179-191 | A | G | S | 4250 | 8181 |
| 317 | 99-14186-424 | A | G | S | 4251 | 8182 |
| 318 | 99-14197-144 | A | G | S | 4252 | 8183 |
| 319 | 99-14203-268 | A | C | S | 4253 | 8184 |
| 320 | 99-14204-468 | G | T | A | 4254 | 8185 |
| 321 | 99-14220-351 | A | G | S | 4255 | 8186 |
| 322 | 99-1423-361 | A | C | S | 4256 | 8187 |
| 323 | 99-14250-381 | A | G | S | 4257 | 8188 |
| 324 | 99-14254-305 | G | T | A | 4258 | 8189 |
| 325 | 99-14256-133 | C | T | A | 4259 | 8190 |
| 326 | 99-1426-185 | C | T | S | 4260 | 8191 |
| 327 | 99-14260-261 | C | T | A | 4261 | 8192 |

TABLE 1-continued

| SEQ ID No. | Marker Name | Allele 1ST | Allele 2ND | Preferred microseq. primer | Amplification primer Upstream (PU) | Amplification primer Downstream (RP) |
|---|---|---|---|---|---|---|
| 328 | 99-14277-73 | A | G | S | 4262 | 8193 |
| 329 | 99-14282-334 | A | C | S | 4263 | 8194 |
| 330 | 99-14285-381 | C | T | A | 4264 | 8195 |
| 331 | 99-14286-220 | G | T | A | 4265 | 8196 |
| 332 | 99-14309-259 | C | T | S | 4266 | 8197 |
| 333 | 99-14315-405 | A | C | S | 4267 | 8198 |
| 334 | 99-14329-205 | G | C | S | 4268 | 8199 |
| 335 | 99-14331-64 | A | G | S | 4269 | 8200 |
| 336 | 99-14332-437 | C | T | A | 4270 | 8201 |
| 337 | 99-14343-408 | A | G | S | 4271 | 8202 |
| 338 | 99-14345-139 | C | T | A | 4272 | 8203 |
| 339 | 99-14356-141 | A | G | S | 4273 | 8204 |
| 340 | 99-1437-325 | C | T | S | 4274 | 8205 |
| 341 | 99-14385-117 | A | T | S | 4275 | 8206 |
| 342 | 99-14392-431 | A | C | S | 4276 | 8207 |
| 343 | 99-14393-190 | C | T | A | 4277 | 8208 |
| 344 | 99-144-392 | C | T | S | 4278 | 8209 |
| 345 | 99-14405-105 | A | G | S | 4279 | 8210 |
| 346 | 99-1442-224 | G | T | A | 4280 | 8211 |
| 347 | 99-14444-193 | G | C | S | 4281 | 8212 |
| 348 | 99-14446-337 | A | G | S | 4282 | 8213 |
| 349 | 99-14452-263 | C | T | S | 4283 | 8214 |
| 350 | 99-14459-44 | G | C | S | 4284 | 8215 |
| 351 | 99-14468-247 | C | T | A | 4285 | 8216 |
| 352 | 99-14470-243 | A | G | S | 4286 | 8217 |
| 353 | 99-14492-322 | C | T | A | 4287 | 8218 |
| 354 | 99-14497-220 | A | G | S | 4288 | 8219 |
| 355 | 99-14505-250 | C | T | A | 4289 | 8220 |
| 356 | 99-14518-57 | C | T | A | 4290 | 8221 |
| 357 | 99-1453-204 | C | T | S | 4291 | 8222 |
| 358 | 99-14553-224 | C | T | S | 4292 | 8223 |
| 359 | 99-14562-402 | A | G | S | 4293 | 8224 |
| 360 | 99-14566-320 | C | T | A | 4294 | 8225 |
| 361 | 99-14574-310 | G | C | S | 4295 | 8226 |
| 362 | 99-14581-365 | C | T | A | 4296 | 8227 |
| 363 | 99-14591-172 | G | C | S | 4297 | 8228 |
| 364 | 99-14595-210 | C | T | A | 4298 | 8229 |
| 365 | 99-14596-174 | C | T | A | 4299 | 8230 |
| 366 | 99-14597-85 | G | C | S | 4300 | 8231 |
| 367 | 99-14598-91 | C | T | A | 4301 | 8232 |
| 368 | 99-14599-220 | C | T | A | 4302 | 8233 |
| 369 | 99-14600-207 | A | G | S | 4303 | 8234 |
| 370 | 99-14601-448 | C | T | A | 4304 | 8235 |
| 371 | 99-14607-267 | C | T | A | 4305 | 8236 |
| 372 | 99-14609-467 | G | T | A | 4306 | 8237 |
| 373 | 99-14610-351 | A | C | S | 4307 | 8238 |
| 374 | 99-14611-241 | G | C | S | 4308 | 8239 |
| 375 | 99-14612-100 | G | C | S | 4309 | 8240 |
| 376 | 99-14614-248 | A | G | S | 4310 | 8241 |
| 377 | 99-14615-65 | A | G | S | 4311 | 8242 |
| 378 | 99-14616-35 | A | G | S | 4312 | 8243 |
| 379 | 99-14618-147 | G | C | S | 4313 | 8244 |
| 380 | 99-14619-325 | A | C | S | 4314 | 8245 |
| 381 | 99-1462-238 | G | C | S | 4315 | 8246 |
| 382 | 99-14620-253 | C | T | A | 4316 | 8247 |
| 383 | 99-14621-96 | G | C | S | 4317 | 8248 |
| 384 | 99-14622-276 | C | T | A | 4318 | 8249 |
| 385 | 99-14626-307 | A | G | S | 4319 | 8250 |
| 386 | 99-14627-272 | C | T | A | 4320 | 8251 |
| 387 | 99-14628-312 | A | C | S | 4321 | 8252 |
| 388 | 99-14629-274 | A | G | S | 4322 | 8253 |
| 389 | 99-14630-75 | C | T | A | 4323 | 8254 |
| 390 | 99-14634-350 | A | G | S | 4324 | 8255 |
| 391 | 99-14635-296 | G | C | S | 4325 | 8256 |
| 392 | 99-14637-366 | G | C | S | 4326 | 8257 |
| 393 | 99-14638-276 | A | G | S | 4327 | 8258 |
| 394 | 99-14643-27 | C | T | S | 4328 | 8259 |
| 395 | 99-14644-395 | G | C | S | 4329 | 8260 |
| 396 | 99-14647-227 | C | T | A | 4330 | 8261 |
| 397 | 99-14651-205 | A | G | S | 4331 | 8262 |
| 398 | 99-14652-120 | A | G | S | 4332 | 8263 |
| 399 | 99-14653-138 | C | T | A | 4333 | 8264 |
| 400 | 99-14662-352 | A | G | S | 4334 | 8265 |
| 401 | 99-14664-289 | C | T | A | 4335 | 8266 |
| 402 | 99-14665-199 | A | G | S | 4336 | 8267 |
| 403 | 99-14669-238 | A | G | S | 4337 | 8268 |
| 404 | 99-14671-175 | C | T | A | 4338 | 8269 |
| 405 | 99-14676-313 | A | T | S | 4339 | 8270 |
| 406 | 99-14677-358 | G | C | S | 4340 | 8271 |
| 407 | 99-14678-75 | G | C | S | 4341 | 8272 |
| 408 | 99-14679-241 | C | T | A | 4342 | 8273 |
| 409 | 99-14468-435 | C | T | S | 4343 | 8274 |
| 410 | 99-1469-47 | G | C | S | 4344 | 8275 |
| 411 | 99-14690-84 | G | T | A | 4345 | 8276 |
| 412 | 99-14692-46 | A | G | S | 4346 | 8277 |
| 413 | 99-14699-149 | C | T | A | 4347 | 8278 |
| 414 | 99-147-181 | A | G | A | 4348 | 8279 |
| 415 | 99-14701-264 | A | G | S | 4349 | 8280 |
| 416 | 99-14704-59 | A | C | S | 4350 | 8281 |
| 417 | 99-14708-142 | G | T | A | 4351 | 8282 |
| 418 | 99-14676-571 | C | T | S | 4352 | 8283 |
| 419 | 99-14710-107 | C | T | A | 4353 | 8284 |
| 420 | 99-14712-163 | C | T | A | 4354 | 8285 |
| 421 | 99-14714-237 | C | T | S | 4355 | 8286 |
| 422 | 99-14717-132 | A | G | S | 4356 | 8287 |
| 423 | 99-1472-435 | A | G | A | 4357 | 8288 |
| 424 | 99-14722-272 | C | T | A | 4358 | 8289 |
| 425 | 99-14729-284 | A | T | S | 4359 | 8290 |
| 426 | 99-14733-26 | A | T | S | 4360 | 8291 |
| 427 | 99-14735-328 | A | G | S | 4361 | 8292 |
| 428 | 99-1474-156 | G | T | A | 4362 | 8293 |
| 429 | 99-14746-377 | A | G | S | 4363 | 8294 |
| 430 | 99-14753-194 | G | T | A | 4364 | 8295 |
| 431 | 99-14756-270 | A | T | S | 4365 | 8296 |
| 432 | 99-1476-172 | G | C | S | 4366 | 8297 |
| 433 | 99-14761-194 | A | G | S | 4367 | 8298 |
| 434 | 99-14773-383 | G | T | A | 4368 | 8299 |
| 435 | 99-14776-79 | G | C | S | 4369 | 8300 |
| 436 | 99-14777-100 | C | T | S | 4370 | 8301 |
| 437 | 99-14782-152 | G | C | S | 4371 | 8302 |
| 438 | 99-14784-212 | A | G | S | 4372 | 8303 |
| 439 | 99-14785-92 | A | C | S | 4373 | 8304 |
| 440 | 99-14786-59 | A | G | S | 4374 | 8305 |
| 441 | 99-1479-158 | C | T | S | 4375 | 8306 |
| 442 | 99-14792-43 | C | T | S | 4376 | 8307 |
| 443 | 99-14796-227 | C | T | A | 4377 | 8308 |
| 444 | 99-14799-57 | A | G | S | 4378 | 8309 |
| 445 | 99-148-182 | A | G | A | 4379 | 8310 |
| 446 | 99-14480-290 | G | T | A | 4380 | 8311 |
| 447 | 99-14802-60 | A | T | S | 4381 | 8312 |
| 448 | 99-14803-157 | C | T | A | 4382 | 8313 |
| 449 | 99-14804-216 | A | G | S | 4383 | 8314 |
| 450 | 99-14805-58 | A | G | S | 4384 | 8315 |
| 451 | 99-14806-108 | G | C | S | 4385 | 8316 |
| 452 | 99-14807-150 | G | C | S | 4386 | 8317 |
| 453 | 99-1481-285 | G | T | A | 4387 | 8318 |
| 454 | 99-14810-407 | C | T | A | 4388 | 8319 |
| 455 | 99-14812-189 | G | C | S | 4389 | 8320 |
| 456 | 99-14817-323 | C | T | A | 4390 | 8321 |
| 457 | 99-14818-430 | A | G | S | 4391 | 8322 |
| 458 | 99-14819-278 | G | C | S | 4392 | 8323 |
| 459 | 99-14820-76 | A | T | S | 4393 | 8324 |
| 460 | 99-14821-48 | C | T | A | 4394 | 8325 |
| 461 | 99-14826-238 | G | T | A | 4395 | 8326 |
| 462 | 99-14828-214 | C | T | A | 4396 | 8327 |
| 463 | 99-14833-226 | A | T | S | 4397 | 8328 |
| 464 | 99-1484-328 | G | C | S | 4398 | 8329 |
| 465 | 99-14843-195 | G | T | A | 4399 | 8330 |
| 466 | 99-14844-143 | C | T | A | 4400 | 8331 |
| 467 | 99-1485-251 | G | T | A | 4401 | 8332 |
| 468 | 99-14850-136 | A | G | S | 4402 | 8333 |
| 469 | 99-14856-260 | A | G | S | 4403 | 8334 |
| 470 | 99-14861-387 | A | G | S | 4404 | 8335 |
| 471 | 99-14862-171 | A | T | S | 4405 | 8336 |
| 472 | 99-14865-386 | A | G | S | 4406 | 8337 |
| 473 | 99-14867-160 | A | T | S | 4407 | 8338 |

TABLE 1-continued

| SEQ ID No. | Marker Name | Allele 1ST | 2ND | Preferred microseq. primer | Amplification primer Upstream (PU) | Downstream (RP) |
|---|---|---|---|---|---|---|
| 474 | 99-14872-326 | A | G | S | 4408 | 8339 |
| 475 | 99-14873453 | C | T | A | 4409 | 8340 |
| 476 | 99-14875-411 | C | T | A | 4410 | 8341 |
| 477 | 99-14879-398 | G | C | S | 4411 | 8342 |
| 478 | 99-14881-231 | C | T | A | 4412 | 8343 |
| 479 | 99-14882-382 | G | C | S | 4413 | 8344 |
| 480 | 99-14883-123 | G | C | S | 4414 | 8345 |
| 481 | 99-1489-76 | A | C | S | 4415 | 8346 |
| 482 | 99-14890-358 | G | T | A | 4416 | 8347 |
| 483 | 99-14892-237 | A | G | S | 4417 | 8348 |
| 484 | 99-14894-52 | A | G | S | 4418 | 8349 |
| 485 | 99-14895-343 | C | T | A | 4419 | 8350 |
| 486 | 99-14897-356 | C | T | A | 4420 | 8351 |
| 487 | 99-1490-381 | C | T | S | 4421 | 8352 |
| 488 | 99-14907-411 | G | T | A | 4422 | 8353 |
| 489 | 99-1493-280 | A | G | A | 4423 | 8354 |
| 490 | 99-14937-42 | A | C | S | 4424 | 8355 |
| 491 | 99-14939-240 | A | C | S | 4425 | 8356 |
| 492 | 99-1494-598 | A | G | A | 4426 | 8357 |
| 493 | 99-14940-224 | A | G | S | 4427 | 8358 |
| 494 | 99-14950-346 | A | T | S | 4428 | 8359 |
| 495 | 99-14959-81 | A | T | S | 4429 | 8360 |
| 496 | 99-14961-193 | G | C | S | 4430 | 8361 |
| 497 | 99-14962-120 | A | G | S | 4431 | 8362 |
| 498 | 99-14966-187 | A | G | S | 4432 | 8363 |
| 499 | 99-14970-352 | A | G | S | 4433 | 8364 |
| 500 | 99-14978-200 | G | T | A | 4434 | 8365 |
| 501 | 99-1498-120 | C | T | S | 4435 | 8366 |
| 502 | 99-14983-186 | G | T | A | 4436 | 8367 |
| 503 | 99-14984-35 | C | T | A | 4437 | 8368 |
| 504 | 99-15005-169 | C | T | A | 4438 | 8369 |
| 505 | 99-15007-369 | A | G | S | 4439 | 8370 |
| 506 | 99-1501-296 | A | G | A | 4440 | 8371 |
| 507 | 99-15016-293 | C | T | A | 4441 | 8372 |
| 508 | 99-15018-270 | A | G | S | 4442 | 8373 |
| 509 | 99-15019-408 | A | G | S | 4443 | 8374 |
| 510 | 99-15021-189 | A | G | S | 4444 | 8375 |
| 511 | 99-15030-271 | A | C | S | 4445 | 8376 |
| 512 | 99-15039-277 | G | T | A | 4446 | 8377 |
| 513 | 99-1504-252 | A | G | A | 4447 | 8378 |
| 514 | 99-15043-175 | A | G | S | 4448 | 8379 |
| 515 | 99-15046-54 | C | T | A | 4449 | 8380 |
| 516 | 99-1506-505 | C | T | S | 4450 | 8381 |
| 517 | 99-15072-64 | C | T | A | 4451 | 8382 |
| 518 | 99-15087-77 | C | T | A | 4452 | 8383 |
| 519 | 99-15098-367 | C | T | A | 4453 | 8384 |
| 520 | 99-151-94 | A | G | A | 4454 | 8385 |
| 521 | 99-15100-363 | C | T | A | 4455 | 8386 |
| 522 | 99-15101-154 | G | C | S | 4456 | 8387 |
| 523 | 99-15106-451 | C | T | A | 4457 | 8388 |
| 524 | 99-15107-228 | A | G | S | 4458 | 8389 |
| 525 | 99-15112-358 | C | T | A | 4459 | 8390 |
| 526 | 99-15118-69 | A | G | S | 4460 | 8391 |
| 527 | 99-15123-180 | C | T | A | 4461 | 8392 |
| 528 | 99-15128-349 | C | T | A | 4462 | 8393 |
| 529 | 99-15129-279 | C | T | A | 4463 | 8394 |
| 530 | 99-15135-231 | A | G | S | 4464 | 8395 |
| 531 | 99-15137-386 | A | G | S | 4465 | 8396 |
| 532 | 99-1515-402 | A | G | A | 4466 | 8397 |
| 533 | 99-15160-270 | A | G | S | 4467 | 8398 |
| 534 | 99-15164-67 | C | T | A | 4468 | 8399 |
| 535 | 99-15193-143 | G | T | A | 4469 | 8400 |
| 536 | 99-15195-377 | A | C | S | 4470 | 8401 |
| 537 | 99-15199-179 | C | T | A | 4471 | 8402 |
| 538 | 99-1520-143 | C | T | S | 4472 | 8403 |
| 539 | 99-15200-196 | A | G | S | 4473 | 8404 |
| 540 | 99-15202-357 | G | C | S | 4474 | 8405 |
| 541 | 99-1521-457 | G | C | S | 4475 | 8406 |
| 542 | 99-1525-102 | C | T | A | 4476 | 8407 |
| 543 | 99-15290-343 | G | T | A | 4477 | 8408 |
| 544 | 99-15296-326 | G | C | S | 4478 | 8409 |
| 545 | 99-15302-371 | G | T | A | 4479 | 8410 |
| 546 | 99-15307-251 | C | T | A | 4480 | 8411 |
| 547 | 99-15310-385 | A | G | S | 4481 | 8412 |
| 548 | 99-15325-95 | A | G | A | 4482 | 8413 |
| 549 | 99-15328-328 | C | T | A | 4483 | 8414 |
| 550 | 99-1533-471 | G | T | A | 4484 | 8415 |
| 551 | 99-15330-301 | G | C | S | 4485 | 8416 |
| 552 | 99-15335-313 | A | G | S | 4486 | 8417 |
| 553 | 99-15339-378 | C | T | A | 4487 | 8418 |
| 554 | 99-15345-376 | G | T | A | 4488 | 8419 |
| 555 | 99-1535-241 | C | T | S | 4489 | 8420 |
| 556 | 99-1537-243 | G | T | A | 4490 | 8421 |
| 557 | 99-15374-99 | A | G | S | 4491 | 8422 |
| 558 | 99-15377-206 | A | G | S | 4492 | 8423 |
| 559 | 99-15382-388 | G | T | A | 4493 | 8424 |
| 560 | 99-15393-177 | A | T | S | 4494 | 8425 |
| 561 | 99-15406-220 | A | C | S | 4495 | 8426 |
| 562 | 99-15425-132 | C | T | A | 4496 | 8427 |
| 563 | 99-15441-337 | A | C | S | 4497 | 8428 |
| 564 | 99-15446-339 | A | G | S | 4498 | 8429 |
| 565 | 99-15457-171 | A | C | S | 4499 | 8430 |
| 566 | 99-15458-308 | C | T | A | 4500 | 8431 |
| 567 | 99-15473-339 | A | C | S | 4501 | 8432 |
| 568 | 99-15486-309 | A | C | S | 4502 | 8433 |
| 569 | 99-15489-305 | G | C | S | 4503 | 8434 |
| 570 | 99-1549-124 | A | G | A | 4504 | 8435 |
| 571 | 99-15490-398 | A | C | S | 4505 | 8436 |
| 572 | 99-15493-197 | A | G | S | 4506 | 8437 |
| 573 | 99-15500-77 | A | G | S | 4507 | 8438 |
| 574 | 99-15502-250 | G | C | S | 4508 | 8439 |
| 575 | 99-15503-85 | G | T | A | 4509 | 8440 |
| 576 | 99-15507-248 | C | T | A | 4510 | 8441 |
| 577 | 99-15508-259 | C | T | A | 4511 | 8442 |
| 578 | 99-15511-278 | A | G | S | 4512 | 8443 |
| 579 | 99-15516-155 | A | G | S | 4513 | 8444 |
| 580 | 99-15524-224 | C | T | A | 4514 | 8445 |
| 581 | 99-15526-324 | A | T | S | 4515 | 8446 |
| 582 | 99-15527-154 | A | G | S | 4516 | 8447 |
| 583 | 99-15528-333 | A | G | S | 4517 | 8448 |
| 584 | 99-1553-544 | A | C | S | 4518 | 8449 |
| 585 | 99-15543-55 | C | T | A | 4519 | 8450 |
| 586 | 99-15545-282 | A | G | S | 4520 | 8451 |
| 587 | 99-15557-50 | A | G | S | 4521 | 8452 |
| 588 | 99-1557-251 | C | T | S | 4522 | 8453 |
| 589 | 99-15574-261 | G | T | A | 4523 | 8454 |
| 590 | 99-15575-278 | G | T | A | 4524 | 8455 |
| 591 | 99-1558-26 | C | T | S | 4525 | 8456 |
| 592 | 99-15595-41 | A | G | A | 4526 | 8457 |
| 593 | 99-15596-64 | C | T | S | 4527 | 8458 |
| 594 | 99-15599-252 | A | G | S | 4528 | 8459 |
| 595 | 99-15605-221 | A | G | S | 4529 | 8460 |
| 596 | 99-15606-326 | C | T | A | 4530 | 8461 |
| 597 | 99-15625-299 | G | C | S | 4531 | 8462 |
| 598 | 99-15627-324 | A | C | S | 4532 | 8463 |
| 599 | 99-15636-159 | A | G | S | 4533 | 8464 |
| 600 | 99-15638-65 | C | T | A | 4534 | 8465 |
| 601 | 99-15648-83 | A | G | S | 4535 | 8466 |
| 602 | 99-15659-332 | G | C | S | 4536 | 8467 |
| 603 | 99-1568-240 | A | T | S | 4537 | 8468 |
| 604 | 99-15705-110 | C | T | S | 4538 | 8469 |
| 605 | 99-15717-120 | C | T | A | 4539 | 8470 |
| 606 | 99-15718-234 | C | T | A | 4540 | 8471 |
| 607 | 99-1572-440 | C | T | S | 4541 | 8472 |
| 608 | 99-15728-334 | A | T | S | 4542 | 8473 |
| 609 | 99-15739-113 | C | T | A | 4543 | 8474 |
| 610 | 99-15744-344 | C | T | A | 4544 | 8475 |
| 611 | 99-15747-185 | C | T | A | 4545 | 8476 |
| 612 | 99-15748-360 | A | C | S | 4546 | 8477 |
| 613 | 99-15756-54 | C | T | A | 4547 | 8478 |
| 614 | 99-15758-119 | C | T | A | 4548 | 8479 |
| 615 | 99-15762-455 | A | G | S | 4549 | 8480 |
| 616 | 99-1577-105 | A | G | A | 4550 | 8481 |
| 617 | 99-15774-268 | A | G | S | 4551 | 8482 |
| 618 | 99-15776-158 | C | T | A | 4552 | 8483 |
| 619 | 99-1578-496 | C | T | S | 4553 | 8484 |

TABLE 1-continued

| SEQ ID No. | Marker Name | Allele 1ST | Allele 2ND | Preferred microseq. primer | Amplification primer Upstream (PU) | Amplification primer Downstream (RP) |
|---|---|---|---|---|---|---|
| 620 | 99-15798-86 | C | T | A | 4554 | 8485 |
| 621 | 99-15803-52 | A | G | S | 4555 | 8486 |
| 622 | 99-15805-327 | A | G | S | 4556 | 8487 |
| 623 | 99-1582430 | C | T | S | 4557 | 8488 |
| 624 | 99-15826-407 | G | T | A | 4558 | 8489 |
| 625 | 99-15830-282 | A | G | S | 4559 | 8490 |
| 626 | 99-1585-373 | C | T | S | 4560 | 8491 |
| 627 | 99-1587-281 | A | G | A | 4561 | 8492 |
| 628 | 99-15891-215 | A | G | S | 4562 | 8493 |
| 629 | 99-15910-116 | A | C | S | 4563 | 8494 |
| 630 | 99-15916-270 | A | G | S | 4564 | 8495 |
| 631 | 99-15925-331 | C | T | A | 4565 | 8496 |
| 632 | 99-15947-109 | C | T | A | 4566 | 8497 |
| 633 | 99-15965-67 | A | G | S | 4567 | 8498 |
| 634 | 99-15966-87 | C | T | A | 4568 | 8499 |
| 635 | 99-15968-59 | A | G | S | 4569 | 8500 |
| 636 | 99-1597-162 | A | G | A | 4570 | 8501 |
| 637 | 99-15970-56 | A | G | S | 4571 | 8502 |
| 638 | 99-15973-73 | C | T | A | 4572 | 8503 |
| 639 | 99-15981-298 | A | G | S | 4573 | 8504 |
| 640 | 99-15985-354 | A | G | S | 4574 | 8505 |
| 641 | 99-15992-145 | A | C | S | 4575 | 8506 |
| 642 | 99-15996-361 | G | T | A | 4576 | 8507 |
| 643 | 99-16003-91 | G | C | S | 4577 | 8508 |
| 644 | 99-16005-314 | C | T | A | 4578 | 8509 |
| 645 | 99-1601-402 | A | T | S | 4579 | 8510 |
| 646 | 99-1602-200 | G | C | S | 4580 | 8511 |
| 647 | 99-16022-325 | A | G | S | 4581 | 8512 |
| 648 | 99-16023-160 | G | C | S | 4582 | 8513 |
| 649 | 99-16030-317 | A | G | S | 4583 | 8514 |
| 650 | 99-1605-112 | A | G | A | 4584 | 8515 |
| 651 | 99-1607-373 | A | G | A | 4585 | 8516 |
| 652 | 99-1611-382 | A | G | A | 4586 | 8517 |
| 653 | 99-16121-51 | C | T | A | 4587 | 8518 |
| 654 | 99-16128-88 | C | T | A | 4588 | 8519 |
| 655 | 99-16129-69 | C | T | A | 4589 | 8520 |
| 656 | 99-16139-79 | A | G | S | 4590 | 8521 |
| 657 | 99-16140-324 | A | G | S | 4591 | 8522 |
| 658 | 99-1615-118 | A | G | A | 4592 | 8523 |
| 659 | 99-16166-331 | A | G | S | 4593 | 8524 |
| 660 | 99-16167-130 | G | C | S | 4594 | 8525 |
| 661 | 99-16188-76 | A | G | S | 4595 | 8526 |
| 662 | 99-16192-217 | A | C | S | 4596 | 8527 |
| 663 | 99-16198-203 | A | T | S | 4597 | 8528 |
| 664 | 99-16202-240 | A | G | S | 4598 | 8529 |
| 665 | 99-16205-255 | A | G | S | 4599 | 8530 |
| 666 | 99-16210-217 | A | T | S | 4600 | 8531 |
| 667 | 99-1622-158 | G | C | S | 4601 | 8532 |
| 668 | 99-16221-161 | G | C | S | 4602 | 8533 |
| 669 | 99-16227-270 | A | G | S | 4603 | 8534 |
| 670 | 99-1623-145 | C | T | S | 4604 | 8535 |
| 671 | 99-16247-447 | A | G | S | 4605 | 8536 |
| 672 | 99-16254-304 | A | G | S | 4606 | 8537 |
| 673 | 99-16260-277 | A | G | S | 4607 | 8538 |
| 674 | 99-16262-232 | C | T | A | 4608 | 8539 |
| 675 | 99-16265-88 | G | C | S | 4609 | 8540 |
| 676 | 99-16279-409 | G | T | A | 4610 | 8541 |
| 677 | 99-16308-315 | A | G | S | 4611 | 8542 |
| 678 | 99-16346-433 | C | T | A | 4612 | 8543 |
| 679 | 99-16366-425 | A | T | S | 4613 | 8544 |
| 680 | 99-16637-345 | C | T | S | 4614 | 8545 |
| 681 | 99-16375-469 | C | T | A | 4615 | 8546 |
| 682 | 99-1638-571 | C | T | S | 4616 | 8547 |
| 683 | 99-16386-484 | G | C | S | 4617 | 8548 |
| 684 | 99-16396-174 | C | T | A | 4618 | 8549 |
| 685 | 99-16399-135 | A | C | S | 4619 | 8550 |
| 686 | 99-16403-273 | A | G | S | 4620 | 8551 |
| 687 | 99-16407-260 | A | C | S | 4621 | 8552 |
| 688 | 99-16409-58 | A | T | S | 4622 | 8553 |
| 689 | 99-16414-297 | A | C | S | 4623 | 8554 |
| 690 | 99-16445-444 | C | T | A | 4624 | 8555 |
| 691 | 99-16466-419 | A | C | S | 4625 | 8556 |
| 692 | 99-16474-299 | G | T | A | 4626 | 8557 |
| 693 | 99-16500-380 | A | T | S | 4627 | 8558 |
| 694 | 99-16505-368 | G | C | S | 4628 | 8559 |
| 695 | 99-16526-375 | A | C | S | 4629 | 8560 |
| 696 | 99-16528-194 | C | T | A | 4630 | 8561 |
| 697 | 99-16531-251 | A | G | S | 4631 | 8562 |
| 698 | 99-16535-344 | C | T | A | 4632 | 8563 |
| 699 | 99-16559-90 | A | G | S | 4633 | 8564 |
| 700 | 99-16562-182 | A | G | S | 4634 | 8565 |
| 701 | 99-16563-263 | G | C | S | 4635 | 8566 |
| 702 | 99-16564-118 | A | G | S | 4636 | 8567 |
| 703 | 99-16568-283 | G | T | A | 4637 | 8568 |
| 704 | 99-16569-65 | A | G | S | 4638 | 8569 |
| 705 | 99-16658-474 | C | T | S | 4639 | 8570 |
| 706 | 99-16611-318 | A | C | S | 4640 | 8571 |
| 707 | 99-1664-289 | C | T | S | 4641 | 8572 |
| 708 | 99-16655-135 | C | T | S | 4642 | 8573 |
| 709 | 99-16657-361 | A | G | S | 4643 | 8574 |
| 710 | 99-16677-346 | C | T | S | 4644 | 8575 |
| 711 | 99-16683-465 | A | C | S | 4645 | 8576 |
| 712 | 99-16692-343 | G | T | A | 4646 | 8577 |
| 713 | 99-16697-149 | A | C | S | 4647 | 8578 |
| 714 | 99-16708-273 | A | G | A | 4648 | 8579 |
| 715 | 99-16740-391 | G | T | A | 4649 | 8580 |
| 716 | 99-16768-54 | A | T | S | 4650 | 8581 |
| 717 | 99-16801-374 | C | T | S | 4651 | 8582 |
| 718 | 99-16827-356 | A | G | A | 4652 | 8583 |
| 719 | 99-16838-212 | C | T | S | 4653 | 8584 |
| 720 | 99-16841-120 | A | T | S | 4654 | 8585 |
| 721 | 99-16842-362 | A | G | A | 4655 | 8586 |
| 722 | 99-16845-234 | A | G | A | 4656 | 8587 |
| 723 | 99-16847-405 | A | G | A | 4657 | 8588 |
| 724 | 99-16855-84 | G | C | S | 4658 | 8589 |
| 725 | 99-16867-193 | C | T | S | 4659 | 8590 |
| 726 | 99-16873-407 | G | C | S | 4660 | 8591 |
| 727 | 99-16886-198 | G | T | A | 4661 | 8592 |
| 728 | 99-16891-264 | C | j | A | 4662 | 8593 |
| 729 | 99-16894-85 | C | T | A | 4663 | 8594 |
| 730 | 99-16895-56 | A | C | S | 4664 | 8595 |
| 731 | 99-16903-53 | A | G | S | 4665 | 8596 |
| 732 | 99-16905-281 | C | T | A | 4666 | 8597 |
| 733 | 99-16906-114 | A | G | S | 4667 | 8598 |
| 734 | 99-16913-94 | A | G | S | 4668 | 8599 |
| 735 | 99-16914-412 | A | G | S | 4669 | 8600 |
| 736 | 99-16929-479 | A | C | S | 4670 | 8601 |
| 737 | 99-16930-306 | C | T | A | 4671 | 8602 |
| 738 | 99-16933-33 | A | G | S | 4672 | 8603 |
| 739 | 99-16946-157 | A | C | S | 4673 | 8604 |
| 740 | 99-16948-390 | A | T | S | 4674 | 8605 |
| 741 | 99-16952-248 | A | C | S | 4675 | 8606 |
| 742 | 99-16975-253 | G | C | S | 4676 | 8607 |
| 743 | 99-16979-274 | A | G | S | 4677 | 8608 |
| 744 | 99-16990-155 | C | T | A | 4678 | 8609 |
| 745 | 99-16994-63 | A | G | S | 4679 | 8610 |
| 746 | 99-17001-311 | C | T | A | 4680 | 8611 |
| 747 | 99-17008-420 | C | T | S | 4681 | 8612 |
| 748 | 99-1701-39 | A | G | A | 4682 | 8613 |
| 749 | 99-17013-217 | G | T | A | 4683 | 8614 |
| 750 | 99-17016-258 | A | G | A | 4684 | 8615 |
| 751 | 99-17028-56 | A | G | A | 4685 | 8616 |
| 752 | 99-17045-267 | A | G | A | 4686 | 8617 |
| 753 | 99-17048-207 | A | C | S | 4687 | 8618 |
| 754 | 99-17052-71 | A | G | A | 4688 | 8619 |
| 755 | 99-17062-102 | A | G | S | 4689 | 8620 |
| 756 | 99-17065-230 | A | G | S | 4690 | 8621 |
| 757 | 99-17084-191 | A | G | S | 4691 | 8622 |
| 758 | 99-1709-597 | G | C | S | 4692 | 8623 |
| 759 | 99-17094-132 | C | T | S | 4693 | 8624 |
| 760 | 99-17095-424 | A | G | S | 4694 | 8625 |
| 761 | 99-1710-249 | G | C | S | 4695 | 8626 |
| 762 | 99-17103-142 | C | T | A | 4696 | 8627 |
| 763 | 99-17105-147 | A | G | S | 4697 | 8628 |
| 764 | 99-17112-191 | C | T | A | 4698 | 8629 |
| 765 | 99-17122-255 | G | C | S | 4699 | 8630 |

TABLE 1-continued

| SEQ ID No. | Marker Name | Allele 1ST | Allele 2ND | Preferred microseq. primer | Amplification primer Upstream (PU) | Amplification primer Downstream (RP) |
|---|---|---|---|---|---|---|
| 766 | 99-17123-320 | C | T | A | 4700 | 8631 |
| 767 | 99-17133-327 | A | T | S | 4701 | 8632 |
| 768 | 99-17134-82 | C | T | A | 4702 | 8633 |
| 769 | 99-17136-384 | A | G | S | 4703 | 8634 |
| 770 | 99-17154-256 | A | G | S | 4704 | 8635 |
| 771 | 99-17157-33 | A | G | S | 4705 | 8636 |
| 772 | 99-17159-280 | A | G | S | 4706 | 8637 |
| 773 | 99-17164-252 | G | C | S | 4707 | 8638 |
| 774 | 99-17165-359 | A | G | S | 4708 | 8639 |
| 775 | 99-17169-485 | A | T | S | 4709 | 8640 |
| 776 | 99-17176-315 | A | G | S | 4710 | 8641 |
| 777 | 99-17180-309 | A | G | S | 4711 | 8642 |
| 778 | 99-17204-105 | A | G | S | 4712 | 8643 |
| 779 | 99-17205-68 | C | T | A | 4713 | 8644 |
| 780 | 99-17213-128 | C | T | A | 4714 | 8645 |
| 781 | 99-1723-101 | A | G | A | 4715 | 8646 |
| 782 | 99-17253-394 | G | T | A | 4716 | 8647 |
| 783 | 99-17262-65 | G | T | A | 4717 | 8648 |
| 784 | 99-17274-353 | A | G | A | 4718 | 8649 |
| 785 | 99-17282-138 | A | T | S | 4719 | 8650 |
| 786 | 99-17306-27 | C | T | A | 4720 | 8651 |
| 787 | 99-17315-86 | A | T | S | 4721 | 8652 |
| 788 | 99-17343-305 | A | G | S | 4722 | 8653 |
| 789 | 99-17347-160 | C | T | A | 4723 | 8654 |
| 790 | 99-17351-259 | G | T | A | 4724 | 8655 |
| 791 | 99-17352-284 | C | T | A | 4725 | 8656 |
| 792 | 99-17357-244 | C | T | A | 4726 | 8657 |
| 793 | 99-17363-245 | A | G | S | 4727 | 8658 |
| 794 | 99-17365-188 | A | G | S | 4728 | 8659 |
| 795 | 99-17375-363 | G | C | S | 4729 | 8660 |
| 796 | 99-1738-72 | A | G | A | 4730 | 8661 |
| 797 | 99-17389-164 | G | T | A | 4731 | 8662 |
| 798 | 99-1739-135 | A | C | S | 4732 | 8663 |
| 799 | 99-17409-293 | C | T | S | 4733 | 8664 |
| 800 | 99-17412-296 | C | T | A | 4734 | 8665 |
| 801 | 99-17416-310 | A | G | S | 4735 | 8666 |
| 802 | 99-17418-41 | A | T | S | 4736 | 8667 |
| 803 | 99-17420-380 | A | G | S | 4737 | 8668 |
| 804 | 99-17428-129 | A | G | S | 4738 | 8669 |
| 805 | 99-17450-352 | A | G | S | 4739 | 8670 |
| 806 | 99-17464-376 | C | T | A | 4740 | 8671 |
| 807 | 99-17476-141 | A | C | S | 4741 | 8672 |
| 808 | 99-17481-171 | C | T | A | 4742 | 8673 |
| 809 | 99-17483-282 | G | T | A | 4743 | 8674 |
| 810 | 99-17490-199 | A | G | S | 4744 | 8675 |
| 811 | 99-17491-362 | C | T | A | 4745 | 8676 |
| 812 | 99-17495-100 | A | C | S | 4746 | 8677 |
| 813 | 99-17496-301 | A | C | S | 4747 | 8678 |
| 814 | 99-17498-312 | C | T | A | 4748 | 8679 |
| 815 | 99-17499-62 | A | G | S | 4749 | 8680 |
| 816 | 99-17520-31 | C | T | A | 4750 | 8681 |
| 817 | 99-17522-423 | A | G | S | 4751 | 8682 |
| 818 | 99-17523-116 | A | C | S | 4752 | 8683 |
| 819 | 99-17529-210 | A | G | S | 4753 | 8684 |
| 820 | 99-17557-358 | C | T | A | 4754 | 8685 |
| 821 | 99-17563-102 | G | C | S | 4755 | 8686 |
| 822 | 99-17588-501 | A | G | S | 4756 | 8687 |
| 823 | 99-17610-44 | A | G | S | 4757 | 8688 |
| 824 | 99-17629-89 | G | T | A | 4758 | 8689 |
| 825 | 99-1764-65 | G | C | S | 4759 | 8690 |
| 826 | 99-17647-79 | A | G | S | 4760 | 8691 |
| 827 | 99-1765-171 | C | T | S | 4761 | 8692 |
| 828 | 99-17656-239 | A | G | S | 4762 | 8693 |
| 829 | 99-17658-167 | A | G | S | 4763 | 8694 |
| 830 | 99-17662-126 | C | T | A | 4764 | 8695 |
| 831 | 99-17663-29 | A | G | S | 4765 | 8696 |
| 832 | 99-17677-251 | A | G | A | 4766 | 8697 |
| 833 | 99-17680-451 | C | T | S | 4767 | 8698 |
| 834 | 99-17683-286 | A | G | A | 4768 | 8699 |
| 835 | 99-17687-373 | C | T | S | 4769 | 8700 |
| 836 | 99-17700-191 | G | C | S | 4770 | 8701 |
| 837 | 99-17702-57 | G | T | A | 4771 | 8702 |
| 838 | 99-17718-259 | C | T | S | 4772 | 8703 |
| 839 | 99-17720-224 | G | C | S | 4773 | 8704 |
| 840 | 99-17728-310 | A | C | S | 4774 | 8705 |
| 841 | 99-17773-343 | C | T | S | 4775 | 8706 |
| 842 | 99-17740-227 | G | C | S | 4776 | 8707 |
| 843 | 99-17775-187 | A | G | A | 4777 | 8708 |
| 844 | 99-17758-292 | A | G | A | 4778 | 8709 |
| 845 | 99-17762-327 | A | G | A | 4779 | 8710 |
| 846 | 99-17773-392 | C | T | S | 4780 | 8711 |
| 847 | 99-17774-276 | C | T | S | 4781 | 8712 |
| 848 | 99-17775-286 | C | T | S | 4782 | 8713 |
| 849 | 99-17776-114 | A | T | S | 4783 | 8714 |
| 850 | 99-17779-117 | A | C | S | 4784 | 8715 |
| 851 | 99-17792-144 | C | T | S | 4785 | 8716 |
| 852 | 99-17798-345 | C | T | S | 4786 | 8717 |
| 853 | 99-17802-338 | A | G | A | 4787 | 8718 |
| 854 | 99-17808-398 | G | C | S | 4788 | 8719 |
| 855 | 99-1781-129 | A | G | A | 4789 | 8720 |
| 856 | 99-17810-366 | C | T | S | 4790 | 8721 |
| 857 | 99-17816-377 | G | C | S | 4791 | 8722 |
| 858 | 99-17820-316 | A | G | A | 4792 | 8723 |
| 859 | 99-17821-109 | A | G | S | 4793 | 8724 |
| 860 | 99-17827-106 | A | C | S | 4794 | 8725 |
| 861 | 99-17829-412 | G | C | S | 4795 | 8726 |
| 862 | 99-17833-108 | G | T | A | 4796 | 8727 |
| 863 | 99-17845-286 | A | G | A | 4797 | 8728 |
| 864 | 99-17854-229 | C | T | S | 4798 | 8729 |
| 865 | 99-17856-308 | G | C | S | 4799 | 8730 |
| 866 | 99-17857-251 | A | G | A | 4800 | 8731 |
| 867 | 99-17863-257 | A | G | A | 4801 | 8732 |
| 868 | 99-17864-202 | G | T | A | 4802 | 8733 |
| 869 | 99-17866-124 | C | T | S | 4803 | 8734 |
| 870 | 99-17889-148 | G | C | S | 4804 | 8735 |
| 871 | 99-17890-58 | C | T | S | 4805 | 8736 |
| 872 | 99-17899-140 | A | G | A | 4806 | 8737 |
| 873 | 99-17913-222 | G | T | A | 4807 | 8738 |
| 874 | 99-17920-382 | A | G | A | 4808 | 8739 |
| 875 | 99-1793-225 | A | T | S | 4809 | 8740 |
| 876 | 99-17938-131 | A | G | A | 4810 | 8741 |
| 877 | 99-17945-63 | A | T | S | 4811 | 8742 |
| 878 | 99-17946-69 | A | C | S | 4812 | 8743 |
| 879 | 99-17952-370 | C | T | S | 4813 | 8744 |
| 880 | 99-1796-184 | A | T | S | 4814 | 8745 |
| 881 | 99-17971-78 | A | G | A | 4815 | 8746 |
| 882 | 99-17976-132 | G | C | S | 4816 | 8747 |
| 883 | 99-17989-85 | A | G | A | 4817 | 8748 |
| 884 | 99-17991-412 | A | T | S | 4818 | 8749 |
| 885 | 99-17992-404 | A | G | A | 4819 | 8750 |
| 886 | 99-18004-125 | C | T | S | 4820 | 8751 |
| 887 | 99-18007-159 | C | T | S | 4821 | 8752 |
| 888 | 99-18030-54 | A | T | S | 4822 | 8753 |
| 889 | 99-18038-384 | G | C | S | 4823 | 8754 |
| 890 | 99-18046-65 | A | T | S | 4824 | 8755 |
| 891 | 99-18053-328 | A | G | S | 4825 | 8756 |
| 892 | 99-18054-392 | A | C | S | 4826 | 8757 |
| 893 | 99-18056-354 | A | G | S | 4827 | 8758 |
| 894 | 99-18057-55 | A | C | S | 4828 | 8759 |
| 895 | 99-18060-203 | G | T | A | 4829 | 8760 |
| 896 | 99-18062-187 | A | G | A | 4830 | 8761 |
| 897 | 99-18069-282 | C | T | A | 4831 | 8762 |
| 898 | 99-18079-46 | G | C | S | 4832 | 8763 |
| 899 | 99-1808-291 | A | T | S | 4833 | 8764 |
| 900 | 99-18080-378 | G | T | A | 4834 | 8765 |
| 901 | 99-18085-94 | A | G | S | 4835 | 8766 |
| 902 | 99-18086-434 | A | G | S | 4836 | 8767 |
| 903 | 99-18087-152 | C | T | A | 4837 | 8768 |
| 904 | 99-18091-47 | G | C | S | 4838 | 8769 |
| 905 | 99-18096-198 | C | T | A | 4839 | 8770 |
| 906 | 99-18109-159 | C | T | A | 4840 | 8771 |
| 907 | 99-1813-310 | C | T | S | 4841 | 8772 |
| 908 | 99-18130-258 | A | G | S | 4842 | 8773 |
| 909 | 99-1814-245 | A | G | A | 4843 | 8774 |
| 910 | 99-18171-95 | G | T | A | 4844 | 8775 |
| 911 | 99-18172-284 | A | G | S | 4845 | 8776 |

TABLE 1-continued

| SEQ ID No. | Marker Name | Preferred Allele 1ST | 2ND | microseq. primer | Amplification primer Upstream (PU) | Downstream (RP) |
|---|---|---|---|---|---|---|
| 912 | 99-18179-185 | G | T | A | 4846 | 8777 |
| 913 | 99-18198-203 | C | T | A | 4847 | 8778 |
| 914 | 99-18201-23 | A | G | S | 4848 | 8779 |
| 915 | 99-18206-76 | A | G | S | 4849 | 8780 |
| 916 | 99-18210-30 | G | C | S | 4850 | 8781 |
| 917 | 99-18213-185 | A | G | S | 4851 | 8782 |
| 918 | 99-18214-86 | A | C | S | 4852 | 8783 |
| 919 | 99-18221-207 | C | T | A | 4853 | 8784 |
| 920 | 99-1823-157 | A | G | A | 4854 | 8785 |
| 921 | 99-1824-226 | A | G | A | 4855 | 8786 |
| 922 | 99-18242-369 | A | G | S | 4856 | 8787 |
| 923 | 99-18253-407 | C | T | S | 4857 | 8788 |
| 924 | 99-18255-259 | A | T | S | 4858 | 8789 |
| 925 | 99-18258-45 | G | C | S | 4859 | 8790 |
| 926 | 99-18268-460 | A | G | A | 4860 | 8791 |
| 927 | 99-18272-287 | G | C | S | 4861 | 8792 |
| 928 | 99-18276-390 | A | G | S | 4862 | 8793 |
| 929 | 99-18288-205 | A | G | A | 4863 | 8794 |
| 930 | 99-18289-36 | C | T | S | 4864 | 8795 |
| 931 | 99-18303-79 | C | T | S | 4865 | 8796 |
| 932 | 99-18306-377 | A | G | A | 4866 | 8797 |
| 933 | 99-18307-371 | A | C | S | 4867 | 8798 |
| 934 | 99-18310-262 | C | T | S | 4868 | 8799 |
| 935 | 99-18312-58 | C | T | S | 4869 | 8800 |
| 936 | 99-18341-95 | G | T | A | 4870 | 8801 |
| 937 | 99-18344-284 | A | G | A | 4871 | 8802 |
| 938 | 99-18345-107 | C | T | S | 4872 | 8803 |
| 939 | 99-18371-433 | A | T | S | 4873 | 8804 |
| 940 | 99-18373-27 | A | G | A | 4874 | 8805 |
| 941 | 99-18375-237 | A | G | A | 4875 | 8806 |
| 942 | 99-18379-485 | C | T | S | 4876 | 8807 |
| 943 | 99-18386-177 | A | T | S | 4877 | 8808 |
| 944 | 99-18394-132 | G | T | A | 4878 | 8809 |
| 945 | 99-18402-255 | C | T | S | 4879 | 8810 |
| 946 | 99-18406-155 | A | G | A | 4880 | 8811 |
| 947 | 99-18414-204 | A | C | S | 4881 | 8812 |
| 948 | 99-18418-127 | G | C | S | 4882 | 8813 |
| 949 | 99-1842-78 | C | T | S | 4883 | 8814 |
| 950 | 99-18423-336 | A | G | A | 4884 | 8815 |
| 951 | 99-18427-314 | C | T | S | 4885 | 8816 |
| 952 | 99-18438-398 | C | T | S | 4886 | 8817 |
| 953 | 99-18442-283 | C | T | S | 4887 | 8818 |
| 954 | 99-18444-185 | C | T | S | 4888 | 8819 |
| 955 | 99-18458-191 | A | G | A | 4889 | 8820 |
| 956 | 99-18470-119 | A | T | S | 4890 | 8821 |
| 957 | 99-18478-101 | A | G | A | 4891 | 8822 |
| 958 | 99-18486-49 | A | G | A | 4892 | 8823 |
| 959 | 99-18487-236 | C | T | S | 4893 | 8824 |
| 960 | 99-18488-273 | A | G | A | 4894 | 8825 |
| 961 | 99-1849-421 | C | T | S | 4895 | 8826 |
| 962 | 99-18536-290 | G | T | A | 4896 | 8827 |
| 963 | 99-18542-232 | A | C | S | 4897 | 8828 |
| 964 | 99-18551-389 | G | C | S | 4898 | 8829 |
| 965 | 99-18561-371 | A | C | S | 4899 | 8830 |
| 966 | 99-18573-363 | G | T | A | 4900 | 8831 |
| 967 | 99-18582-422 | A | G | A | 4901 | 8832 |
| 968 | 99-18588-175 | A | C | S | 4902 | 8833 |
| 969 | 99-18596-83 | A | G | A | 4903 | 8834 |
| 970 | 99-18597-415 | C | T | S | 4904 | 8835 |
| 971 | 99-18599-347 | A | G | A | 4905 | 8836 |
| 972 | 99-1860-281 | A | G | A | 4906 | 8837 |
| 973 | 99-18602-241 | A | G | A | 4907 | 8838 |
| 974 | 99-18606-324 | C | T | S | 4908 | 8839 |
| 975 | 99-1861-191 | G | C | S | 4909 | 8840 |
| 976 | 99-18612-184 | C | T | S | 4910 | 8841 |
| 977 | 99-18618-455 | C | T | S | 4911 | 8842 |
| 978 | 99-18620-125 | C | T | S | 4912 | 8843 |
| 979 | 99-18637-281 | C | T | A | 4913 | 8844 |
| 980 | 99-18638-164 | C | T | A | 4914 | 8845 |
| 981 | 99-18640-458 | C | T | A | 4915 | 8846 |
| 982 | 99-18648-71 | C | T | A | 4916 | 8847 |
| 983 | 99-18666-483 | G | T | A | 4917 | 8848 |
| 984 | 99-18667-392 | G | C | S | 4918 | 8849 |
| 985 | 99-18669-223 | G | C | S | 4919 | 8850 |
| 986 | 99-18715-172 | A | G | A | 4920 | 8851 |
| 987 | 99-18719-225 | C | T | S | 4921 | 8852 |
| 988 | 99-18720-235 | C | T | S | 4922 | 8853 |
| 989 | 99-18721-442 | A | G | A | 4923 | 8854 |
| 990 | 99-18724-409 | C | T | S | 4924 | 8855 |
| 991 | 99-18729-377 | A | T | S | 4925 | 8856 |
| 992 | 99-18873-193 | C | T | A | 4926 | 8857 |
| 993 | 99-18744-170 | A | G | A | 4927 | 8858 |
| 994 | 99-18745-423 | A | G | A | 4928 | 8859 |
| 995 | 99-18747-72 | C | T | S | 4929 | 8860 |
| 996 | 99-18751-217 | G | T | A | 4930 | 8861 |
| 997 | 99-18755-267 | C | T | S | 4931 | 8862 |
| 998 | 99-18774-69 | G | T | A | 4932 | 8863 |
| 999 | 99-18775-161 | G | T | A | 4933 | 8864 |
| 1000 | 99-18777-130 | C | T | S | 4934 | 8865 |
| 1001 | 99-18802-308 | G | C | S | 4935 | 8866 |
| 1002 | 99-18808-155 | C | T | S | 4936 | 8867 |
| 1003 | 99-18814-275 | G | C | S | 4937 | 8868 |
| 1004 | 99-18822-289 | C | T | A | 4938 | 8869 |
| 1005 | 99-18822-368 | C | T | S | 4939 | 8870 |
| 1006 | 99-18826-378 | C | T | S | 4940 | 8871 |
| 1007 | 99-18827-92 | A | G | A | 4941 | 8872 |
| 1008 | 99-18883-121 | G | T | A | 4942 | 8873 |
| 1009 | 99-18847-263 | C | T | S | 4943 | 8874 |
| 1010 | 99-18853-64 | G | T | A | 4944 | 8875 |
| 1011 | 99-18855-173 | A | G | A | 4945 | 8876 |
| 1012 | 99-18860-308 | C | T | S | 4946 | 8877 |
| 1013 | 99-18861-23 | C | T | S | 4947 | 8878 |
| 1014 | 99-18888-162 | C | T | S | 4948 | 8879 |
| 1015 | 99-18890-125 | C | T | A | 4949 | 8880 |
| 1016 | 99-18895-67 | A | C | S | 4950 | 8881 |
| 1017 | 99-18974-99 | A | G | A | 4951 | 8882 |
| 1018 | 99-18976-135 | A | T | S | 4952 | 8883 |
| 1019 | 99-18982-345 | C | T | S | 4953 | 8884 |
| 1020 | 99-18986-248 | G | C | S | 4954 | 8885 |
| 1021 | 99-18987-191 | A | G | A | 4955 | 8886 |
| 1022 | 99-18995-300 | C | T | S | 4956 | 8887 |
| 1023 | 99-18996-388 | A | G | A | 4957 | 8888 |
| 1024 | 99-19008-237 | C | T | S | 4958 | 8889 |
| 1025 | 99-19013-384 | C | T | S | 4959 | 8890 |
| 1026 | 99-19016-51 | A | G | A | 4960 | 8891 |
| 1027 | 99-1909-387 | G | T | A | 4961 | 8892 |
| 1028 | 99-1910-94 | C | T | S | 4962 | 8893 |
| 1029 | 99-1916-91 | G | T | A | 4963 | 8894 |
| 1030 | 99-1917-434 | A | T | S | 4964 | 8895 |
| 1031 | 99-19253-102 | A | G | A | 4965 | 8896 |
| 1032 | 99-19256-149 | C | T | S | 4966 | 8897 |
| 1033 | 99-1934-272 | A | G | A | 4967 | 8898 |
| 1034 | 99-1936-289 | C | T | S | 4968 | 8899 |
| 1035 | 99-1944-379 | C | T | S | 4969 | 8900 |
| 1036 | 99-1947-205 | A | G | S | 4970 | 8901 |
| 1037 | 99-1948-49 | G | C | S | 4971 | 8902 |
| 1038 | 99-1953-287 | A | G | A | 4972 | 8903 |
| 1039 | 99-1955-443 | A | G | A | 4973 | 8904 |
| 1040 | 99-1960-424 | A | T | S | 4974 | 8905 |
| 1041 | 99-1964-53 | C | T | S | 4975 | 8906 |
| 1042 | 99-1977-440 | A | G | S | 4976 | 8907 |
| 1043 | 99-1997-139 | G | T | A | 4977 | 8908 |
| 1044 | 99-19999-92 | C | T | S | 4978 | 8909 |
| 1045 | 99-2000-240 | G | T | A | 4979 | 8910 |
| 1046 | 99-20000-252 | A | G | A | 4980 | 8911 |
| 1047 | 99-2001-177 | A | G | S | 4981 | 8912 |
| 1048 | 99-20011-229 | C | T | S | 4982 | 8913 |
| 1049 | 99-20018-244 | G | C | S | 4983 | 8914 |
| 1050 | 99-20023-386 | A | T | S | 4984 | 8915 |
| 1051 | 99-2003-509 | G | C | S | 4985 | 8916 |
| 1052 | 99-20032-90 | G | T | A | 4986 | 8917 |
| 1053 | 99-20033-186 | G | T | A | 4987 | 8918 |
| 1054 | 99-20035-283 | A | C | S | 4988 | 8919 |
| 1055 | 99-2004-35 | C | T | S | 4989 | 8920 |
| 1056 | 99-2005-466 | G | C | S | 4990 | 8921 |
| 1057 | 99-20057-166 | C | T | S | 4991 | 8922 |

TABLE 1-continued

| SEQ ID No. | Marker Name | Allele 1ST | Allele 2ND | Preferred microseq. primer | Amplification primer Upstream (PU) | Amplification primer Downstream (RP) |
|---|---|---|---|---|---|---|
| 1058 | 99-20061-56 | C | T | S | 4992 | 8923 |
| 1059 | 99-20062-181 | A | G | A | 4993 | 8924 |
| 1060 | 99-2007-278 | C | T | S | 4994 | 8925 |
| 1061 | 99-20074-154 | A | C | S | 4995 | 8926 |
| 1062 | 99-20090-81 | A | C | S | 4996 | 8927 |
| 1063 | 99-2010-363 | C | T | A | 4997 | 8928 |
| 1064 | 99-20110-65 | G | T | A | 4998 | 8929 |
| 1065 | 99-2012-243 | A | G | A | 4999 | 8930 |
| 1066 | 99-20154-451 | A | T | S | 5000 | 8931 |
| 1067 | 99-20156-212 | A | G | A | 5001 | 8932 |
| 1068 | 99-20198-54 | C | T | S | 5002 | 8933 |
| 1069 | 99-2020-281 | C | T | A | 5003 | 8934 |
| 1070 | 99-20208-176 | A | G | A | 5004 | 8935 |
| 1071 | 99-2022-200 | A | C | S | 5005 | 8936 |
| 1072 | 99-2024-132 | A | G | A | 5006 | 8937 |
| 1073 | 99-2025-234 | C | T | A | 5007 | 8938 |
| 1074 | 99-20250-362 | A | T | S | 5008 | 8939 |
| 1075 | 99-2027-296 | A | G | S | 5009 | 8940 |
| 1076 | 99-20294-274 | C | T | S | 5010 | 8941 |
| 1077 | 99-20303-127 | C | T | S | 5011 | 8942 |
| 1078 | 99-20313-311 | A | G | A | 5012 | 8943 |
| 1079 | 99-20320-321 | C | T | S | 5013 | 8944 |
| 1080 | 99-20326-130 | A | G | A | 5014 | 8945 |
| 1081 | 99-20332-432 | A | G | A | 5015 | 8946 |
| 1082 | 99-20335-48 | C | T | S | 5016 | 8947 |
| 1083 | 99-20340-161 | A | G | A | 5017 | 8948 |
| 1084 | 99-20348-403 | A | G | A | 5018 | 8949 |
| 1085 | 99-2035-323 | C | T | S | 5019 | 8950 |
| 1086 | 99-20353-229 | A | G | A | 5020 | 8951 |
| 1087 | 99-20357-359 | A | T | S | 5021 | 8952 |
| 1088 | 99-2036-168 | A | T | S | 5022 | 8953 |
| 1089 | 99-2037-470 | C | T | S | 5023 | 8954 |
| 1090 | 99-20385-215 | C | T | S | 5024 | 8955 |
| 1091 | 99-2041-141 | A | G | A | 5025 | 8956 |
| 1092 | 99-2042-439 | G | C | S | 5026 | 8957 |
| 1093 | 99-20420-274 | C | T | S | 5027 | 8958 |
| 1094 | 99-20423-430 | C | T | S | 5028 | 8959 |
| 1095 | 99-20424-330 | C | T | S | 5029 | 8960 |
| 1096 | 99-20428-271 | C | T | S | 5030 | 8961 |
| 1097 | 99-2043-220 | A | T | S | 5031 | 8962 |
| 1098 | 99-2046-275 | A | G | A | 5032 | 8963 |
| 1099 | 99-20469-213 | C | T | S | 5033 | 8964 |
| 1100 | 99-2048-267 | G | C | S | 5034 | 8965 |
| 1101 | 99-20480-233 | C | T | S | 5035 | 8966 |
| 1102 | 99-20481-131 | G | C | S | 5036 | 8967 |
| 1103 | 99-20485-269 | A | G | A | 5037 | 8968 |
| 1104 | 99-20493-238 | G | T | A | 5038 | 8969 |
| 1105 | 99-20499-364 | A | T | S | 5039 | 8970 |
| 1106 | 99-20504-90 | A | G | A | 5040 | 8971 |
| 1107 | 99-20508-456 | C | T | S | 5041 | 8972 |
| 1108 | 99-2051-360 | A | C | S | 5042 | 8973 |
| 1109 | 99-20511-221 | C | T | S | 5043 | 8974 |
| 1110 | 99-20514-71 | A | G | A | 5044 | 8975 |
| 1111 | 99-20518-456 | A | G | A | 5045 | 8976 |
| 1112 | 99-2052-376 | G | T | A | 5046 | 8977 |
| 1113 | 99-20527-220 | A | T | S | 5047 | 8978 |
| 1114 | 99-2053-386 | A | G | A | 5048 | 8979 |
| 1115 | 99-20531-285 | A | C | S | 5049 | 8980 |
| 1116 | 99-2054-93 | A | G | S | 5050 | 8981 |
| 1117 | 99-20542-248 | A | G | A | 5051 | 8982 |
| 1118 | 99-20549-141 | A | G | A | 5052 | 8983 |
| 1119 | 99-2055-236 | A | G | A | 5053 | 8984 |
| 1120 | 99-20552-37 | C | T | S | 5054 | 8985 |
| 1121 | 99-2056-474 | C | T | S | 5055 | 8986 |
| 1122 | 99-20561-126 | G | T | A | 5056 | 8987 |
| 1123 | 99-20565-190 | C | T | S | 5057 | 8988 |
| 1124 | 99-20566-376 | A | G | A | 5058 | 8989 |
| 1125 | 99-20567-268 | C | T | S | 5059 | 8990 |
| 1126 | 99-20568-284 | A | C | S | 5060 | 8991 |
| 1127 | 99-2058-168 | G | T | A | 5061 | 8992 |
| 1128 | 99-20581-125 | A | T | S | 5062 | 8993 |
| 1129 | 99-20594-103 | G | C | S | 5063 | 8994 |
| 1130 | 99-2060-322 | A | T | S | 5064 | 8995 |
| 1131 | 99-2061-257 | A | C | S | 5065 | 8996 |
| 1132 | 99-20616-287 | C | T | S | 5066 | 8997 |
| 1133 | 99-20623-354 | C | T | S | 5067 | 8998 |
| 1134 | 99-2063-451 | A | G | A | 5068 | 8999 |
| 1135 | 99-20639-257 | C | T | S | 5069 | 9000 |
| 1136 | 99-20642-382 | A | G | A | 5070 | 9001 |
| 1137 | 99-20651-108 | A | G | A | 5071 | 9002 |
| 1138 | 99-20656-171 | C | T | S | 5072 | 9003 |
| 1139 | 99-20659-289 | C | T | S | 5073 | 9004 |
| 1140 | 99-20675-407 | G | C | S | 5074 | 9005 |
| 1141 | 99-20677-289 | C | T | S | 5075 | 9006 |
| 1142 | 99-20683-98 | A | C | S | 5076 | 9007 |
| 1143 | 99-20688-310 | A | G | A | 5077 | 9008 |
| 1144 | 99-20723-206 | C | T | S | 5078 | 9009 |
| 1145 | 99-20726-494 | A | G | A | 5079 | 9010 |
| 1146 | 99-20732-413 | G | C | S | 5080 | 9011 |
| 1147 | 99-20738-89 | G | C | S | 5081 | 9012 |
| 1148 | 99-20739-335 | A | G | A | 5082 | 9013 |
| 1149 | 99-2074-273 | A | C | S | 5083 | 9014 |
| 1150 | 99-20746-369 | A | G | A | 5084 | 9015 |
| 1151 | 99-20747-322 | A | G | A | 5085 | 9016 |
| 1152 | 99-20766-117 | A | G | A | 5086 | 9017 |
| 1153 | 99-20768-469 | C | T | S | 5087 | 9018 |
| 1154 | 99-2077-510 | G | C | S | 5088 | 9019 |
| 1155 | 99-20771-171 | A | G | A | 5089 | 9020 |
| 1156 | 99-2078-348 | A | G | A | 5090 | 9021 |
| 1157 | 99-20797-262 | C | T | S | 5091 | 9022 |
| 1158 | 99-20798-87 | C | T | S | 5092 | 9023 |
| 1159 | 99-2080-33 | A | G | A | 5093 | 9024 |
| 1160 | 99-20802-358 | C | T | S | 5094 | 9025 |
| 1161 | 99-20814-222 | C | T | S | 5095 | 9026 |
| 1162 | 99-2082-284 | A | G | A | 5096 | 9027 |
| 1163 | 99-20823-49 | C | T | S | 5097 | 9028 |
| 1164 | 99-20828-131 | C | T | S | 5098 | 9029 |
| 1165 | 99-20830-449 | A | G | A | 5099 | 9030 |
| 1166 | 99-2084-504 | A | G | A | 5100 | 9031 |
| 1167 | 99-2085-172 | C | T | S | 5101 | 9032 |
| 1168 | 99-20850-374 | C | T | S | 5102 | 9033 |
| 1169 | 99-20853-29 | A | G | A | 5103 | 9034 |
| 1170 | 99-20856-158 | C | T | S | 5104 | 9035 |
| 1171 | 99-20867-393 | A | G | A | 5105 | 9036 |
| 1172 | 99-20872-325 | A | C | S | 5106 | 9037 |
| 1173 | 99-20883-234 | C | T | S | 5107 | 9038 |
| 1174 | 99-20887-420 | C | T | S | 5108 | 9039 |
| 1175 | 99-2089-84 | A | G | A | 5109 | 9040 |
| 1176 | 99-20895-36 | A | G | S | 5110 | 9041 |
| 1177 | 99-2092-323 | A | C | S | 5111 | 9042 |
| 1178 | 99-20928-66 | G | C | S | 5112 | 9043 |
| 1179 | 99-2093-278 | C | T | S | 5113 | 9044 |
| 1180 | 99-20938-256 | G | T | A | 5114 | 9045 |
| 1181 | 99-2094-129 | A | G | A | 5115 | 9046 |
| 1182 | 99-20950-251 | G | C | S | 5116 | 9047 |
| 1183 | 99-2098-102 | G | T | A | 5117 | 9048 |
| 1184 | 99-21012-277 | A | C | S | 5118 | 9049 |
| 1185 | 99-21021-273 | C | T | S | 5119 | 9050 |
| 1186 | 99-2103-270 | G | C | S | 5120 | 9051 |
| 1187 | 99-21035-279 | C | T | S | 5121 | 9052 |
| 1188 | 99-21064-278 | C | T | S | 5122 | 9053 |
| 1189 | 99-21070-272 | A | G | A | 5123 | 9054 |
| 1190 | 99-21079-169 | G | T | A | 5124 | 9055 |
| 1191 | 99-21084-496 | C | T | S | 5125 | 9056 |
| 1192 | 99-2109-276 | G | T | A | 5126 | 9057 |
| 1193 | 99-211-291 | A | G | S | 5127 | 9058 |
| 1194 | 99-21141-314 | A | G | A | 5128 | 9059 |
| 1195 | 99-21148-269 | A | G | A | 5129 | 9060 |
| 1196 | 99-21149-129 | A | G | A | 5130 | 9061 |
| 1197 | 99-21167-159 | C | T | S | 5131 | 9062 |
| 1198 | 99-21170-107 | C | T | S | 5132 | 9063 |
| 1199 | 99-21221-96 | A | T | S | 5133 | 9064 |
| 1200 | 99-2126-79 | A | T | S | 5134 | 9065 |
| 1201 | 99-21370-87 | C | T | S | 5135 | 9066 |
| 1202 | 99-2170-188 | G | C | S | 5136 | 9067 |
| 1203 | 99-2172-314 | A | G | S | 5137 | 9068 |

TABLE 1-continued

| SEQ ID No. | Marker Name | Allele 1ST | 2ND | Preferred microseq. primer | Amplification primer Upstream (PU) | Downstream (RP) |
|---|---|---|---|---|---|---|
| 1204 | 99-2173-289 | C | T | S | 5138 | 9069 |
| 1205 | 99-2179-303 | G | T | A | 5139 | 9070 |
| 1206 | 99-2193-225 | A | G | A | 5140 | 9071 |
| 1207 | 99-22011-342 | C | T | S | 5141 | 9072 |
| 1208 | 99-22015-219 | A | G | A | 5142 | 9073 |
| 1209 | 99-22022-145 | A | G | A | 5143 | 9074 |
| 1210 | 99-22027-410 | G | C | S | 5144 | 9075 |
| 1211 | 99-22036-314 | A | T | S | 5145 | 9076 |
| 1212 | 99-22038-381 | G | C | S | 5146 | 9077 |
| 1213 | 99-22044-431 | A | G | A | 5147 | 9078 |
| 1214 | 99-22048-259 | A | G | A | 5148 | 9079 |
| 1215 | 99-22051-261 | C | T | S | 5149 | 9080 |
| 1216 | 99-22066-139 | A | G | A | 5150 | 9081 |
| 1217 | 99-22072-80 | C | T | S | 5151 | 9082 |
| 1218 | 99-22073-381 | G | C | S | 5152 | 9083 |
| 1219 | 99-22078-350 | A | G | A | 5153 | 9084 |
| 1220 | 99-22087-150 | C | T | S | 5154 | 9085 |
| 1221 | 99-2209-111 | A | G | A | 5155 | 9086 |
| 1222 | 99-22091-289 | G | T | A | 5156 | 9087 |
| 1223 | 99-22096-276 | C | T | S | 5157 | 9088 |
| 1224 | 99-22100-265 | C | T | S | 5158 | 9089 |
| 1225 | 99-22102-238 | C | T | S | 5159 | 9090 |
| 1226 | 99-22122-54 | A | G | A | 5160 | 9091 |
| 1227 | 99-22125-126 | C | T | S | 5161 | 9092 |
| 1228 | 99-2214-148 | A | C | S | 5162 | 9093 |
| 1229 | 99-22147-359 | C | T | S | 5163 | 9094 |
| 1230 | 99-22160-331 | A | G | A | 5164 | 9095 |
| 1231 | 99-22167-79 | C | T | S | 5165 | 9096 |
| 1232 | 99-22172-304 | A | T | S | 5166 | 9097 |
| 1233 | 99-2218-219 | A | G | A | 5167 | 9098 |
| 1234 | 99-22189-248 | C | T | S | 5168 | 9099 |
| 1235 | 99-22219-245 | C | T | S | 5169 | 9100 |
| 1236 | 99-22191-339 | C | T | S | 5170 | 9101 |
| 1237 | 99-22192-383 | C | T | S | 5171 | 9102 |
| 1238 | 99-222-109 | C | T | S | 5172 | 9103 |
| 1239 | 99-2220-300 | A | G | A | 5173 | 9104 |
| 1240 | 99-22209-304 | A | C | S | 5174 | 9105 |
| 1241 | 99-22215-391 | A | G | A | 5175 | 9106 |
| 1242 | 99-22217-423 | G | C | S | 5176 | 9107 |
| 1243 | 99-2222-459 | C | T | S | 5177 | 9108 |
| 1244 | 99-22227-275 | A | T | S | 5178 | 9109 |
| 1245 | 99-22255-384 | A | G | A | 5179 | 9110 |
| 1246 | 99-22262-331 | C | T | S | 5180 | 9111 |
| 1247 | 99-22265-294 | A | C | S | 5181 | 9112 |
| 1248 | 99-22266-474 | C | T | S | 5182 | 9113 |
| 1249 | 99-2228-301 | A | G | A | 5183 | 9114 |
| 1250 | 99-2229-240 | G | T | A | 5184 | 9115 |
| 1251 | 99-22333-237 | C | T | S | 5185 | 9116 |
| 1252 | 99-22336-316 | C | T | S | 5186 | 9117 |
| 1253 | 99-22337-199 | A | C | S | 5187 | 9118 |
| 1254 | 99-2235-499 | G | C | S | 5188 | 9119 |
| 1255 | 99-22356-370 | A | C | S | 5189 | 9120 |
| 1256 | 99-22357-186 | C | T | S | 5190 | 9121 |
| 1257 | 99-2240-281 | C | T | S | 5191 | 9122 |
| 1258 | 99-22409-141 | C | T | S | 5192 | 9123 |
| 1259 | 99-2242-206 | C | T | S | 5193 | 9124 |
| 1260 | 99-2244-83 | A | G | A | 5194 | 9125 |
| 1261 | 99-22442-147 | G | T | A | 5195 | 9126 |
| 1262 | 99-22449-216 | G | C | S | 5196 | 9127 |
| 1263 | 99-22453-370 | A | T | S | 5197 | 9128 |
| 1264 | 99-22456-55 | A | C | S | 5198 | 9129 |
| 1265 | 99-2246-340 | A | G | A | 5199 | 9130 |
| 1266 | 99-2248-76 | C | T | S | 5200 | 9131 |
| 1267 | 99-22490-246 | A | G | A | 5201 | 9132 |
| 1268 | 99-22491-79 | G | T | A | 5202 | 9133 |
| 1269 | 99-2250-236 | C | T | S | 5203 | 9134 |
| 1270 | 99-22503-146 | C | T | S | 5204 | 9135 |
| 1271 | 99-22506-395 | C | T | S | 5205 | 9136 |
| 1272 | 99-22513-90 | A | G | A | 5206 | 9137 |
| 1273 | 99-22520-413 | G | C | S | 5207 | 9138 |
| 1274 | 99-22546-125 | C | T | S | 5208 | 9139 |
| 1275 | 99-22565-114 | A | G | A | 5209 | 9140 |
| 1276 | 99-22571-136 | C | T | S | 5210 | 9141 |
| 1277 | 99-22573-321 | A | G | A | 5211 | 9142 |
| 1278 | 99-22578-78 | C | T | S | 5212 | 9143 |
| 1279 | 99-22580-72 | A | T | S | 5213 | 9144 |
| 1280 | 99-22585-462 | G | C | S | 5214 | 9145 |
| 1281 | 99-22586-39 | A | G | S | 5215 | 9146 |
| 1282 | 99-22604-208 | G | T | A | 5216 | 9147 |
| 1283 | 99-22610-343 | A | G | A | 5217 | 9148 |
| 1284 | 99-22615-392 | C | T | S | 5218 | 9149 |
| 1285 | 99-22617-378 | C | T | S | 5219 | 9150 |
| 1286 | 99-22620-404 | C | T | S | 5220 | 9151 |
| 1287 | 99-22628-292 | A | G | A | 5221 | 9152 |
| 1288 | 99-22629-124 | C | T | S | 5222 | 9153 |
| 1289 | 99-22632-237 | G | C | S | 5223 | 9154 |
| 1290 | 99-22646-233 | A | G | A | 5224 | 9155 |
| 1291 | 99-22648-57 | C | T | S | 5225 | 9156 |
| 1292 | 99-22650-64 | A | C | S | 5226 | 9157 |
| 1293 | 99-22652-343 | A | G | A | 5227 | 9158 |
| 1294 | 99-22655-319 | A | T | S | 5228 | 9159 |
| 1295 | 99-22660-386 | A | G | A | 5229 | 9160 |
| 1296 | 99-22662-268 | A | G | A | 5230 | 9161 |
| 1297 | 99-22666-164 | C | T | S | 5231 | 9162 |
| 1298 | 99-22668-232 | G | T | A | 5232 | 9163 |
| 1299 | 99-22674-31 | C | T | S | 5233 | 9164 |
| 1300 | 99-22675-187 | A | G | A | 5234 | 9165 |
| 1301 | 99-22680-130 | C | T | S | 5235 | 9166 |
| 1302 | 99-22683-107 | A | G | A | 5236 | 9167 |
| 1303 | 99-2269-179 | A | G | A | 5237 | 9168 |
| 1304 | 99-22700-358 | A | G | A | 5238 | 9169 |
| 1305 | 99-22701-307 | C | T | S | 5239 | 9170 |
| 1306 | 99-2271-403 | A | G | A | 5240 | 9171 |
| 1307 | 99-22712-242 | A | G | A | 5241 | 9172 |
| 1308 | 99-22718-94 | A | T | S | 5242 | 9173 |
| 1309 | 99-2272-409 | G | T | A | 5243 | 9174 |
| 1310 | 99-22728-207 | A | G | A | 5244 | 9175 |
| 1311 | 99-2273-528 | C | T | S | 5245 | 9176 |
| 1312 | 99-22733-281 | G | C | S | 5246 | 9177 |
| 1313 | 99-22741-180 | A | G | A | 5247 | 9178 |
| 1314 | 99-2275-466 | C | T | S | 5248 | 9179 |
| 1315 | 99-2276-331 | C | T | S | 5249 | 9180 |
| 1316 | 99-22771-150 | A | G | A | 5250 | 9181 |
| 1317 | 99-22775-365 | C | T | S | 5251 | 9182 |
| 1318 | 99-2278-276 | A | G | A | 5252 | 9183 |
| 1319 | 99-22785-431 | A | T | S | 5253 | 9184 |
| 1320 | 99-22843-342 | G | T | A | 5254 | 9185 |
| 1321 | 99-22844-211 | A | G | A | 5255 | 9186 |
| 1322 | 99-22857-88 | C | T | S | 5256 | 9187 |
| 1323 | 99-22868-425 | A | C | S | 5257 | 9188 |
| 1324 | 99-22872-431 | C | T | S | 5258 | 9189 |
| 1325 | 99-2288-144 | C | T | S | 5259 | 9190 |
| 1326 | 99-22917-145 | G | T | A | 5260 | 9191 |
| 1327 | 99-22937-395 | C | T | S | 5261 | 9192 |
| 1328 | 99-22948-262 | C | T | S | 5262 | 9193 |
| 1329 | 99-22954-306 | A | C | S | 5263 | 9194 |
| 1330 | 99-22957-409 | A | G | A | 5264 | 9195 |
| 1331 | 99-22959-239 | A | G | A | 5265 | 9196 |
| 1332 | 99-22964-82 | C | T | S | 5266 | 9197 |
| 1333 | 99-22975-126 | C | T | S | 5267 | 9198 |
| 1334 | 99-23014-300 | A | G | A | 5268 | 9199 |
| 1335 | 99-23018-166 | A | G | A | 5269 | 9200 |
| 1336 | 99-23020-187 | G | T | A | 5270 | 9201 |
| 1337 | 99-23083-59 | C | T | S | 5271 | 9202 |
| 1338 | 99-23100-367 | A | G | A | 5272 | 9203 |
| 1339 | 99-23115-404 | G | C | S | 5273 | 9204 |
| 1340 | 99-23118-402 | A | G | A | 5274 | 9205 |
| 1341 | 99-2312-358 | C | T | S | 5275 | 9206 |
| 1342 | 99-23123-250 | A | G | A | 5276 | 9207 |
| 1343 | 99-23127-314 | G | C | S | 5277 | 9208 |
| 1344 | 99-23132-192 | A | G | A | 5278 | 9209 |
| 1345 | 99-23134-89 | A | G | A | 5279 | 9210 |
| 1346 | 99-2315-213 | A | G | A | 5280 | 9211 |
| 1347 | 99-23150-262 | A | C | S | 5281 | 9212 |
| 1348 | 99-2320-292 | C | T | S | 5282 | 9213 |
| 1349 | 99-23201-345 | C | T | S | 5283 | 9214 |

TABLE 1-continued

| SEQ ID No. | Marker Name | Preferred Allele 1ST | 2ND | microseq. primer | Amplification primer Upstream (PU) | Downstream (RP) |
|---|---|---|---|---|---|---|
| 1350 | 99-23202-185 | A | C | S | 5284 | 9215 |
| 1351 | 99-23204-262 | C | T | S | 5285 | 9216 |
| 1352 | 99-23207-281 | C | T | S | 5286 | 9217 |
| 1353 | 99-2321-82 | C | T | S | 5287 | 9218 |
| 1354 | 99-23228-176 | G | C | S | 5288 | 9219 |
| 1355 | 99-2324-338 | A | C | S | 5289 | 9220 |
| 1356 | 99-23266-146 | A | G | A | 5290 | 9221 |
| 1357 | 99-23269-263 | A | T | S | 5291 | 9222 |
| 1358 | 99-2328-535 | G | C | S | 5292 | 9223 |
| 1359 | 99-23299-424 | A | G | A | 5293 | 9224 |
| 1360 | 99-23302-326 | C | T | S | 5294 | 9225 |
| 1361 | 99-2331-639 | G | T | A | 5295 | 9226 |
| 1362 | 99-23312-93 | A | G | A | 5296 | 9227 |
| 1363 | 99-23317-51 | A | G | A | 5297 | 9228 |
| 1364 | 99-23322-49 | A | G | A | 5298 | 9229 |
| 1365 | 99-23326-120 | A | G | A | 5299 | 9230 |
| 1366 | 99-23328-292 | A | G | A | 5300 | 9231 |
| 1367 | 99-23333-157 | A | G | A | 5301 | 9232 |
| 1368 | 99-23334-443 | A | G | A | 5302 | 9233 |
| 1369 | 99-23359-99 | G | C | S | 5303 | 9234 |
| 1370 | 99-23381-412 | A | G | A | 5304 | 9235 |
| 1371 | 99-23387-404 | G | C | S | 5305 | 9236 |
| 1372 | 99-23413-242 | A | G | A | 5306 | 9237 |
| 1373 | 99-23415-131 | A | G | A | 5307 | 9238 |
| 1374 | 99-23417-128 | G | T | A | 5308 | 9239 |
| 1375 | 99-23437-347 | A | G | A | 5309 | 9240 |
| 1376 | 99-23440-274 | A | G | A | 5310 | 9241 |
| 1377 | 99-23444-203 | A | G | A | 5311 | 9242 |
| 1378 | 99-2345-28 | G | C | A | 5312 | 9243 |
| 1379 | 99-23451-78 | A | G | A | 5313 | 9244 |
| 1380 | 99-23452-306 | G | T | A | 5314 | 9245 |
| 1381 | 99-23454-317 | C | T | A | 5315 | 9246 |
| 1382 | 99-23460-199 | A | C | S | 5316 | 9247 |
| 1383 | 99-23462-192 | C | T | S | 5317 | 9248 |
| 1384 | 99-23463-118 | C | T | S | 5318 | 9249 |
| 1385 | 99-23469-288 | C | T | S | 5319 | 9250 |
| 1386 | 99-2347-207 | A | C | S | 5320 | 9251 |
| 1387 | 99-23473-35 | C | T | S | 5321 | 9252 |
| 1388 | 99-2348-127 | A | G | A | 5322 | 9253 |
| 1389 | 99-23488-239 | A | G | A | 5323 | 9254 |
| 1390 | 99-23492-151 | C | T | S | 5324 | 9255 |
| 1391 | 99-23496-94 | A | G | A | 5325 | 9256 |
| 1392 | 99-2351045 | A | G | A | 5326 | 9257 |
| 1393 | 99-23528-452 | C | T | S | 5327 | 9258 |
| 1394 | 99-2356-322 | A | G | A | 5328 | 9259 |
| 1395 | 99-2362-270 | A | G | A | 5329 | 9260 |
| 1396 | 99-2364-329 | G | C | S | 5330 | 9261 |
| 1397 | 99-2367-61 | A | G | A | 5331 | 9262 |
| 1398 | 99-2368-61 | A | G | A | 5332 | 9263 |
| 1399 | 99-23687-107 | C | T | A | 5333 | 9264 |
| 1400 | 99-237-151 | A | G | A | 5334 | 9265 |
| 1401 | 99-23714-196 | G | C | S | 5335 | 9266 |
| 1402 | 99-23737-186 | C | T | S | 5336 | 9267 |
| 1403 | 99-2375-114 | C | T | A | 5337 | 9268 |
| 1404 | 99-23773-199 | C | T | S | 5338 | 9269 |
| 1405 | 99-2378-200 | A | G | A | 5339 | 9270 |
| 1406 | 99-2381-394 | A | G | A | 5340 | 9271 |
| 1407 | 99-2409-298 | A | G | A | 5341 | 9272 |
| 1408 | 99-241-341 | A | T | S | 5342 | 9273 |
| 1409 | 99-2413-368 | A | G | A | 5343 | 9274 |
| 1410 | 99-2417-177 | C | T | S | 5344 | 9275 |
| 1411 | 99-2419-285 | C | T | S | 5345 | 9276 |
| 1412 | 99-24246-247 | C | T | A | 5346 | 9277 |
| 1413 | 99-24253-437 | A | G | S | 5347 | 9278 |
| 1414 | 99-24259-466 | A | T | S | 5348 | 9279 |
| 1415 | 99-24264-380 | G | C | S | 5349 | 9280 |
| 1416 | 99-24269-417 | C | T | A | 5350 | 9281 |
| 1417 | 99-24270-207 | G | T | A | 5351 | 9282 |
| 1418 | 99-24275-107 | A | G | S | 5352 | 9283 |
| 1419 | 99-24284-213 | A | T | S | 5353 | 9284 |
| 1420 | 99-24286-231 | A | G | S | 5354 | 9285 |
| 1421 | 99-24288-121 | A | G | S | 5355 | 9286 |
| 1422 | 99-24333-37 | A | G | S | 5356 | 9287 |
| 1423 | 99-24342-311 | C | T | A | 5357 | 9288 |
| 1424 | 99-24376-24 | A | G | S | 5358 | 9289 |
| 1425 | 99-24379-319 | C | T | S | 5359 | 9290 |
| 1426 | 99-24381-217 | A | G | S | 5360 | 9291 |
| 1427 | 99-24385-210 | A | T | S | 5361 | 9292 |
| 1428 | 99-24388-391 | A | T | S | 5362 | 9293 |
| 1429 | 99-24390-27 | A | G | S | 5363 | 9294 |
| 1430 | 99-24392-61 | A | C | S | 5364 | 9295 |
| 1431 | 99-24393-108 | A | G | S | 5365 | 9296 |
| 1432 | 99-2440-246 | C | T | S | 5366 | 9297 |
| 1433 | 99-24409-383 | A | G | S | 5367 | 9298 |
| 1434 | 99-24411-420 | G | C | S | 5368 | 9299 |
| 1435 | 99-24427-321 | A | G | S | 5369 | 9300 |
| 1436 | 99-24432-284 | A | C | S | 5370 | 9301 |
| 1437 | 99-24438-402 | A | G | S | 5371 | 9302 |
| 1438 | 99-24441-431 | C | T | A | 5372 | 9303 |
| 1439 | 99-24447-448 | A | T | S | 5373 | 9304 |
| 1440 | 99-2445-79 | C | T | S | 5374 | 9305 |
| 1441 | 99-24454-257 | G | C | S | 5375 | 9306 |
| 1442 | 99-24463-206 | A | G | S | 5376 | 9307 |
| 1443 | 99-24496-171 | C | T | A | 5377 | 9308 |
| 1444 | 99-24506-396 | A | G | S | 5378 | 9309 |
| 1445 | 99-24508-45 | G | C | S | 5379 | 9310 |
| 1446 | 99-24529-330 | A | G | S | 5380 | 9311 |
| 1447 | 99-24534-317 | G | C | S | 5381 | 9312 |
| 1448 | 99-24554-324 | A | G | A | 5382 | 9313 |
| 1449 | 99-24557-406 | G | T | A | 5383 | 9314 |
| 1450 | 99-24561-360 | A | T | S | 5384 | 9315 |
| 1451 | 99-24570-260 | G | C | S | 5385 | 9316 |
| 1452 | 99-24688-312 | C | T | A | 5386 | 9317 |
| 1453 | 99-24725-138 | A | G | S | 5387 | 9318 |
| 1454 | 99-24727-360 | A | G | S | 5388 | 9319 |
| 1455 | 99-24750-293 | C | T | A | 5389 | 9320 |
| 1456 | 99-24778-221 | C | T | A | 5390 | 9321 |
| 1457 | 99-24793-390 | C | T | A | 5391 | 9322 |
| 1458 | 99-24800-565 | G | T | S | 5392 | 9323 |
| 1459 | 99-25005-154 | A | C | S | 5393 | 9324 |
| 1460 | 99-25007-131 | A | T | S | 5394 | 9325 |
| 1461 | 99-25053-114 | A | G | S | 5395 | 9326 |
| 1462 | 99-25055-44 | A | G | S | 5396 | 9327 |
| 1463 | 99-25070-78 | C | T | A | 5397 | 9328 |
| 1464 | 99-25077-124 | A | G | S | 5398 | 9329 |
| 1465 | 99-25129-166 | C | T | A | 5399 | 9330 |
| 1466 | 99-25134-296 | A | G | S | 5400 | 9331 |
| 1467 | 99-2524-98 | A | G | A | 5401 | 9332 |
| 1468 | 99-25246-170 | C | T | A | 5402 | 9333 |
| 1469 | 99-25249-151 | G | T | A | 5403 | 9334 |
| 1470 | 99-2525-142 | A | G | S | 5404 | 9335 |
| 1471 | 99-25255-288 | C | T | A | 5405 | 9336 |
| 1472 | 99-25369-121 | C | T | S | 5406 | 9337 |
| 1473 | 99-25379-389 | C | T | S | 5407 | 9338 |
| 1474 | 99-25382-226 | A | C | S | 5408 | 9339 |
| 1475 | 99-25387-220 | G | T | A | 5409 | 9340 |
| 1476 | 99-25400-379 | C | T | S | 5410 | 9341 |
| 1477 | 99-25412-354 | G | T | A | 5411 | 9342 |
| 1478 | 99-25431-269 | A | C | S | 5412 | 9343 |
| 1479 | 99-25432-119 | C | T | S | 5413 | 9344 |
| 1480 | 99-25433-351 | A | G | S | 5414 | 9345 |
| 1481 | 99-25447-272 | A | G | S | 5415 | 9346 |
| 1482 | 99-25448-348 | G | T | A | 5416 | 9347 |
| 1483 | 99-25452-83 | C | T | A | 5417 | 9348 |
| 1484 | 99-25454-349 | G | T | A | 5418 | 9349 |
| 1485 | 99-25458-103 | G | C | S | 5419 | 9350 |
| 1486 | 99-25503-333 | A | T | S | 5420 | 9351 |
| 1487 | 99-25507-373 | C | T | A | 5421 | 9352 |
| 1488 | 99-25510-390 | A | C | S | 5422 | 9353 |
| 1489 | 99-25538-423 | A | C | S | 5423 | 9354 |
| 1490 | 99-25539-86 | C | T | A | 5424 | 9355 |
| 1491 | 99-25543-390 | A | G | S | 5425 | 9356 |
| 1492 | 99-25575-303 | C | T | A | 5426 | 9357 |
| 1493 | 99-25618-196 | A | C | S | 5427 | 9358 |
| 1494 | 99-25620-360 | C | T | A | 5428 | 9359 |
| 1495 | 99-25629-262 | A | G | S | 5429 | 9360 |

TABLE 1-continued

| SEQ ID No. | Marker Name | Allele 1ST | 2ND | Preferred microseq. primer | Amplification primer Upstream (PU) | Downstream (RP) |
|---|---|---|---|---|---|---|
| 1496 | 99-25657-314 | C | T | A | 5430 | 9361 |
| 1497 | 99-25672-97 | A | G | S | 5431 | 9362 |
| 1498 | 99-25676-211 | C | T | A | 5432 | 9363 |
| 1499 | 99-25678-307 | A | G | S | 5433 | 9364 |
| 1500 | 99-2570-218 | C | T | S | 5434 | 9365 |
| 1501 | 99-25712-418 | C | T | A | 5435 | 9366 |
| 1502 | 99-25716-393 | C | T | A | 5436 | 9367 |
| 1503 | 99-25717-252 | G | T | A | 5437 | 9368 |
| 1504 | 99-25725-80 | A | G | S | 5438 | 9369 |
| 1505 | 99-25732-152 | A | G | S | 5439 | 9370 |
| 1506 | 99-25745-36 | A | G | S | 5440 | 9371 |
| 1507 | 99-25781-275 | C | T | A | 5441 | 9372 |
| 1508 | 99-25836-106 | C | T | S | 5442 | 9373 |
| 1509 | 99-2597-34 | C | T | S | 5443 | 9374 |
| 1510 | 99-26001-224 | A | G | S | 5444 | 9375 |
| 1511 | 99-26002-93 | C | T | A | 5445 | 9376 |
| 1512 | 99-26042-310 | A | G | A | 5446 | 9377 |
| 1513 | 99-26080-152 | C | T | S | 5447 | 9378 |
| 1514 | 99-26082-48 | C | T | S | 5448 | 9379 |
| 1515 | 99-26099-119 | A | G | A | 5449 | 9380 |
| 1516 | 99-2610-121 | A | C | S | 5450 | 9381 |
| 1517 | 99-26105-273 | A | C | S | 5451 | 9382 |
| 1518 | 99-26116-191 | C | T | A | 5452 | 9383 |
| 1519 | 99-2615-83 | C | T | S | 5453 | 9384 |
| 1520 | 99-2620-227 | A | G | A | 5454 | 9385 |
| 1521 | 99-2624-407 | G | T | A | 5455 | 9386 |
| 1522 | 99-2625-70 | A | G | A | 5456 | 9387 |
| 1523 | 99-2637-28 | A | G | A | 5457 | 9388 |
| 1524 | 99-2662-407 | C | T | S | 5458 | 9389 |
| 1525 | 99-2669-233 | A | G | A | 5459 | 9390 |
| 1526 | 99-2675-121 | A | G | A | 5460 | 9391 |
| 1527 | 99-2683-388 | C | T | S | 5461 | 9392 |
| 1528 | 99-342-288 | A | C | S | 5462 | 9393 |
| 1529 | 99-370-205 | A | G | A | 5463 | 9394 |
| 1530 | 99-371-415 | C | T | S | 5464 | 9395 |
| 1531 | 99-388-405 | A | G | A | 5465 | 9396 |
| 1532 | 99-390-246 | G | T | S | 5466 | 9397 |
| 1533 | 99-393-448 | A | T | S | 5467 | 9398 |
| 1534 | 99-397-205 | A | G | A | 5468 | 9399 |
| 1535 | 99-400-102 | G | C | S | 5469 | 9400 |
| 1536 | 99-402-139 | A | G | A | 5470 | 9401 |
| 1537 | 99-404-114 | C | T | S | 5471 | 9402 |
| 1538 | 99-414-349 | G | C | S | 5472 | 9403 |
| 1539 | 99-417-241 | A | G | A | 5473 | 9404 |
| 1540 | 99-426-359 | G | T | S | 5474 | 9405 |
| 1541 | 99-429-115 | A | C | S | 5475 | 9406 |
| 1542 | 99-430-352 | C | T | S | 5476 | 9407 |
| 1543 | 99-435-41 | A | G | A | 5477 | 9408 |
| 1544 | 99-449-344 | G | T | S | 5478 | 9409 |
| 1545 | 99-4536-255 | A | G | A | 5479 | 9410 |
| 1546 | 99-4541-39 | G | T | A | 5480 | 9411 |
| 1547 | 99-4544-287 | A | G | A | 5481 | 9412 |
| 1548 | 99-4547-312 | C | T | S | 5482 | 9413 |
| 1549 | 99-4595-341 | A | T | S | 5483 | 9414 |
| 1550 | 99-4604-26 | A | T | S | 5484 | 9415 |
| 1551 | 994618-240 | C | T | S | 5485 | 9416 |
| 1552 | 99-4625-216 | C | T | S | 5486 | 9417 |
| 1553 | 99-4630-272 | A | G | A | 5487 | 9418 |
| 1554 | 99-4644-107 | A | T | S | 5488 | 9419 |
| 1555 | 99-465-443 | A | C | S | 5489 | 9420 |
| 1556 | 99-4655-145 | C | T | S | 5490 | 9421 |
| 1557 | 99-466-361 | C | T | S | 5491 | 9422 |
| 1558 | 99-4666-185 | C | T | S | 5492 | 9423 |
| 1559 | 99-4674-166 | A | G | A | 5493 | 9424 |
| 1560 | 99-4676-342 | A | G | S | 5494 | 9425 |
| 1561 | 99-4677-58 | C | T | S | 5495 | 9426 |
| 1562 | 99-4679-240 | C | T | A | 5496 | 9427 |
| 1563 | 99-4680-352 | C | T | S | 5497 | 9428 |
| 1564 | 99-4681-228 | A | G | A | 5498 | 9429 |
| 1565 | 99-4682-177 | C | T | S | 5499 | 9430 |
| 1566 | 99-4685-217 | A | G | A | 5500 | 9431 |
| 1567 | 99-4705-226 | G | C | S | 5501 | 9432 |
| 1568 | 99-4714-156 | A | G | A | 5502 | 9433 |
| 1569 | 99-472-70 | C | T | S | 5503 | 9434 |
| 1570 | 99-4725-251 | A | T | S | 5504 | 9435 |
| 1571 | 99-4756-236 | C | T | S | 5505 | 9436 |
| 1572 | 99-4761-279 | A | G | A | 5506 | 9437 |
| 1573 | 99-4777-302 | A | G | A | 5507 | 9438 |
| 1574 | 99-4777-137 | G | C | S | 5508 | 9439 |
| 1575 | 99-4790-305 | A | G | A | 5509 | 9440 |
| 1576 | 99-4796-325 | A | C | S | 5510 | 9441 |
| 1577 | 99-482-130 | C | T | S | 5511 | 9442 |
| 1578 | 99-4822-291 | A | G | A | 5512 | 9443 |
| 1579 | 994823-173 | G | T | A | 5513 | 9444 |
| 1580 | 99-483-424 | A | C | S | 5514 | 9445 |
| 1581 | 99-4836-206 | A | G | A | 5515 | 9446 |
| 1582 | 99-4838-424 | C | T | S | 5516 | 9447 |
| 1583 | 99-4840-368 | C | T | S | 5517 | 9448 |
| 1584 | 99-4844-102 | C | T | S | 5518 | 9449 |
| 1585 | 99-486-243 | C | T | S | 5519 | 9450 |
| 1586 | 99-4863-240 | C | T | S | 5520 | 9451 |
| 1587 | 99-4882-351 | A | T | S | 5521 | 9452 |
| 1588 | 99-4890-255 | G | T | A | 5522 | 9453 |
| 1589 | 99-4891-509 | A | C | S | 5523 | 9454 |
| 1590 | 99-4895-158 | C | T | S | 5524 | 9455 |
| 1591 | 99-490-202 | C | T | S | 5525 | 9456 |
| 1592 | 99-4924-254 | C | T | S | 5526 | 9457 |
| 1593 | 99-4928-102 | C | T | S | 5527 | 9458 |
| 1594 | 99-4950-196 | A | C | S | 5528 | 9459 |
| 1595 | 99-4951-36 | C | T | A | 5529 | 9460 |
| 1596 | 99-4956-236 | A | G | A | 5530 | 9461 |
| 1597 | 99-4966-298 | A | G | A | 5531 | 9462 |
| 1598 | 99-4968-273 | C | T | S | 5532 | 9463 |
| 1599 | 99-5016-206 | C | T | S | 5533 | 9464 |
| 1600 | 99-5029-240 | G | T | A | 5534 | 9465 |
| 1601 | 99-5032-232 | A | C | S | 5535 | 9466 |
| 1602 | 99-5036-40 | C | T | S | 5536 | 9467 |
| 1603 | 99-5038-181 | C | T | S | 5537 | 9468 |
| 1604 | 99-5043-111 | A | C | S | 5538 | 9469 |
| 1605 | 99-5099-245 | A | G | A | 5539 | 9470 |
| 1606 | 99-5101-284 | G | T | A | 5540 | 9471 |
| 1607 | 99-5104-160 | A | G | A | 5541 | 9472 |
| 1608 | 99-5107-184 | G | T | A | 5542 | 9473 |
| 1609 | 99-5108-144 | A | G | A | 5543 | 9474 |
| 1610 | 99-511-33 | C | T | S | 5544 | 9475 |
| 1611 | 99-5130-355 | C | T | S | 5545 | 9476 |
| 1612 | 99-5142-74 | C | T | S | 5546 | 9477 |
| 1613 | 99-5148-269 | G | C | S | 5547 | 9478 |
| 1614 | 99-5149-436 | C | T | S | 5548 | 9479 |
| 1615 | 99-5157-422 | G | C | S | 5549 | 9480 |
| 1616 | 99-5162461 | C | T | S | 5550 | 9481 |
| 1617 | 99-5168-220 | C | T | S | 5551 | 9482 |
| 1618 | 99-5184-146 | A | G | A | 5552 | 9483 |
| 1619 | 99-5186-455 | A | G | A | 5553 | 9484 |
| 1620 | 99-5189-412 | C | T | S | 5554 | 9485 |
| 1621 | 99-5193-430 | A | G | A | 5555 | 9486 |
| 1622 | 99-5194-145 | A | G | A | 5556 | 9487 |
| 1623 | 99-5199-108 | A | T | S | 5557 | 9488 |
| 1624 | 99-5202-145 | A | G | A | 5558 | 9489 |
| 1625 | 99-5224-293 | G | C | S | 5559 | 9490 |
| 1626 | 99-5225-198 | C | T | S | 5560 | 9491 |
| 1627 | 99-5226-215 | A | G | A | 5561 | 9492 |
| 1628 | 99-5247-158 | A | G | A | 5562 | 9493 |
| 1629 | 99-5252-252 | A | G | A | 5563 | 9494 |
| 1630 | 99-5265-288 | C | T | S | 5564 | 9495 |
| 1631 | 99-5290-322 | C | T | S | 5565 | 9496 |
| 1632 | 99-5291-331 | A | C | S | 5566 | 9497 |
| 1633 | 99-5294-362 | A | C | S | 5567 | 9498 |
| 1634 | 99-5306-93 | C | T | S | 5568 | 9499 |
| 1635 | 99-5308-341 | G | C | S | 5569 | 9500 |
| 1636 | 99-5312-273 | C | T | S | 5570 | 9501 |
| 1637 | 99-5326-332 | A | G | A | 5571 | 9502 |
| 1638 | 99-5338-151 | C | T | S | 5572 | 9503 |
| 1639 | 99-5355-165 | A | G | A | 5573 | 9504 |
| 1640 | 99-5356-100 | A | T | S | 5574 | 9505 |
| 1641 | 99-5360-151 | C | T | S | 5575 | 9506 |

TABLE 1-continued

| SEQ ID No. | Marker Name | Allele 1ST | 2ND | Preferred microseq. primer | Amplification primer Upstream (PU) | Downstream (RP) |
|---|---|---|---|---|---|---|
| 1642 | 99-5362-203 | C | T | S | 5576 | 9507 |
| 1643 | 99-5364-95 | C | T | A | 5577 | 9508 |
| 1644 | 99-5379-158 | A | G | A | 5578 | 9509 |
| 1645 | 99-5386-85 | A | G | A | 5579 | 9510 |
| 1646 | 99-5389-409 | A | G | A | 5580 | 9511 |
| 1647 | 99-5390-375 | C | T | S | 5581 | 9512 |
| 1648 | 99-5401-280 | C | T | S | 5582 | 9513 |
| 1649 | 99-5405-376 | C | T | S | 5583 | 9514 |
| 1650 | 99-5406-299 | A | T | S | 5584 | 9515 |
| 1651 | 99-5407-173 | C | T | S | 5585 | 9516 |
| 1652 | 99-5411-378 | C | T | S | 5586 | 9517 |
| 1653 | 99-5416-137 | A | G | A | 5587 | 9518 |
| 1654 | 99-5420-425 | G | C | S | 5588 | 9519 |
| 1655 | 99-5427-466 | A | G | A | 5589 | 9520 |
| 1656 | 99-5432-391 | G | C | S | 5590 | 9521 |
| 1657 | 99-5433-45 | C | T | S | 5591 | 9522 |
| 1658 | 99-5437-159 | A | G | A | 5592 | 9523 |
| 1659 | 99-5438-70 | C | T | S | 5593 | 9524 |
| 1660 | 99-5441-287 | C | T | S | 5594 | 9525 |
| 1661 | 99-5446-303 | C | T | S | 5595 | 9526 |
| 1662 | 99-5447-322 | A | G | A | 5596 | 9527 |
| 1663 | 99-5458-203 | C | T | S | 5597 | 9528 |
| 1664 | 99-5468-319 | A | C | S | 5598 | 9529 |
| 1665 | 99-5472-290 | C | T | S | 5599 | 9530 |
| 1666 | 99-5475-455 | A | G | A | 5600 | 9531 |
| 1667 | 99-5477-207 | A | C | S | 5601 | 9532 |
| 1668 | 99-5485-325 | A | G | A | 5602 | 9533 |
| 1669 | 99-5490-368 | C | T | S | 5603 | 9534 |
| 1670 | 99-5494-205 | A | G | A | 5604 | 9535 |
| 1671 | 99-5502-433 | A | C | S | 5605 | 9536 |
| 1672 | 99-5505-226 | C | T | S | 5606 | 9537 |
| 1673 | 99-5516-121 | C | T | S | 5607 | 9538 |
| 1674 | 99-5526-334 | C | T | S | 5608 | 9539 |
| 1675 | 99-5566-131 | A | G | A | 5609 | 9540 |
| 1676 | 99-5582-71 | G | C | S | 5610 | 9541 |
| 1677 | 99-5590-99 | C | T | S | 5611 | 9542 |
| 1678 | 99-5595-380 | A | G | A | 5612 | 9543 |
| 1679 | 99-5596-216 | A | G | A | 5613 | 9544 |
| 1680 | 99-5604-376 | A | G | A | 5614 | 9545 |
| 1681 | 99-5608-324 | A | G | A | 5615 | 9546 |
| 1682 | 99-5632-425 | A | G | A | 5616 | 9547 |
| 1683 | 99-5633-334 | A | G | A | 5617 | 9548 |
| 1684 | 99-5634-426 | C | T | S | 5618 | 9549 |
| 1685 | 99-5636-198 | C | T | S | 5619 | 9550 |
| 1686 | 99-5660-265 | G | C | S | 5620 | 9551 |
| 1687 | 99-5670-264 | C | T | S | 5621 | 9552 |
| 1688 | 99-5678-321 | A | G | A | 5622 | 9553 |
| 1689 | 99-5680-109 | A | G | A | 5623 | 9554 |
| 1690 | 99-5681-81 | C | T | S | 5624 | 9555 |
| 1691 | 99-5685-274 | A | T | S | 5625 | 9556 |
| 1692 | 99-5686-274 | G | C | S | 5626 | 9557 |
| 1693 | 99-5700-142 | G | C | S | 5627 | 9558 |
| 1694 | 99-5702-192 | C | T | S | 5628 | 9559 |
| 1695 | 99-5703-72 | C | T | S | 5629 | 9560 |
| 1696 | 99-5709-80 | A | G | A | 5630 | 9561 |
| 1697 | 99-5711-206 | C | T | S | 5631 | 9562 |
| 1698 | 99-5712-123 | A | T | S | 5632 | 9563 |
| 1699 | 99-5727-77 | C | T | S | 5633 | 9564 |
| 1700 | 99-5729-370 | A | G | A | 5634 | 9565 |
| 1701 | 99-5731-450 | G | T | A | 5635 | 9566 |
| 1702 | 99-5741-59 | A | G | A | 5636 | 9567 |
| 1703 | 99-5742-337 | C | T | S | 5637 | 9568 |
| 1704 | 99-5745-256 | G | C | S | 5638 | 9569 |
| 1705 | 99-5756-233 | A | G | A | 5639 | 9570 |
| 1706 | 99-576-421 | G | C | S | 5640 | 9571 |
| 1707 | 99-5760-164 | A | G | A | 5641 | 9572 |
| 1708 | 99-5770-275 | C | T | S | 5642 | 9573 |
| 1709 | 99-5781-110 | G | C | S | 5643 | 9574 |
| 1710 | 99-5795-234 | A | C | S | 5644 | 9575 |
| 1711 | 99-5813-34 | A | T | S | 5645 | 9576 |
| 1712 | 99-582-132 | A | G | S | 5646 | 9577 |
| 1713 | 99-5832-136 | C | T | S | 5647 | 9578 |
| 1714 | 99-5836-327 | C | T | S | 5648 | 9579 |
| 1715 | 99-5837-407 | C | T | S | 5649 | 9580 |
| 1716 | 99-5860-278 | A | G | A | 5650 | 9581 |
| 1717 | 99-5867-284 | G | T | A | 5651 | 9582 |
| 1718 | 99-5875-411 | A | G | A | 5652 | 9583 |
| 1719 | 99-5893-211 | A | G | A | 5653 | 9584 |
| 1720 | 99-5907-143 | C | T | S | 5654 | 9585 |
| 1721 | 99-5908-225 | A | G | A | 5655 | 9586 |
| 1722 | 99-5909-292 | C | T | S | 5656 | 9587 |
| 1723 | 99-5912-49 | A | G | A | 5657 | 9588 |
| 1724 | 99-5915-378 | A | G | A | 5658 | 9589 |
| 1725 | 99-5951-438 | C | T | S | 5659 | 9590 |
| 1726 | 99-5957-123 | G | C | S | 5660 | 9591 |
| 1727 | 99-596-228 | G | C | S | 5661 | 9592 |
| 1728 | 99-5968-382 | A | T | S | 5662 | 9593 |
| 1729 | 99-5979-96 | C | T | S | 5663 | 9594 |
| 1730 | 99-598-130 | A | G | A | 5664 | 9595 |
| 1731 | 99-6007-246 | A | C | S | 5665 | 9596 |
| 1732 | 99-6012-220 | G | T | A | 5666 | 9597 |
| 1733 | 99-602-258 | A | G | A | 5667 | 9598 |
| 1734 | 99-6038-286 | A | G | S | 5668 | 9599 |
| 1735 | 99-6042-134 | G | C | S | 5669 | 9600 |
| 1736 | 99-6051-251 | G | C | S | 5670 | 9601 |
| 1737 | 99-6067-247 | C | T | S | 5671 | 9602 |
| 1738 | 99-6069-41 | A | G | A | 5672 | 9603 |
| 1739 | 99-607-397 | A | G | A | 5673 | 9604 |
| 1740 | 99-6077-346 | C | T | S | 5674 | 9605 |
| 1741 | 99-6079-343 | A | G | A | 5675 | 9606 |
| 1742 | 99-608-183 | G | T | A | 5676 | 9607 |
| 1743 | 99-6080-99 | C | T | S | 5677 | 9608 |
| 1744 | 99-609-225 | A | T | S | 5678 | 9609 |
| 1745 | 99-6091-305 | A | G | A | 5679 | 9610 |
| 1746 | 99-6094-223 | C | T | S | 5680 | 9611 |
| 1747 | 99-6095-316 | A | G | A | 5681 | 9612 |
| 1748 | 99-6097-202 | G | T | A | 5682 | 9613 |
| 1749 | 99-610-250 | A | G | A | 5683 | 9614 |
| 1750 | 99-6112-275 | C | T | S | 5684 | 9615 |
| 1751 | 99-6117-221 | A | G | A | 5685 | 9616 |
| 1752 | 99-6122-100 | A | G | A | 5686 | 9617 |
| 1753 | 99-6131-166 | A | G | A | 5687 | 9618 |
| 1754 | 99-6135-319 | C | T | S | 5688 | 9619 |
| 1755 | 99-614-346 | G | C | S | 5689 | 9620 |
| 1756 | 99-6141-339 | C | T | S | 5690 | 9621 |
| 1757 | 99-615-387 | A | C | S | 5691 | 9622 |
| 1758 | 99-616-338 | A | G | A | 5692 | 9623 |
| 1759 | 99-6176-96 | A | G | A | 5693 | 9624 |
| 1760 | 99-6180-389 | G | T | A | 5694 | 9625 |
| 1761 | 99-6181-328 | A | C | S | 5695 | 9626 |
| 1762 | 99-6189-224 | A | G | A | 5696 | 9627 |
| 1763 | 99-619-141 | C | T | S | 5697 | 9628 |
| 1764 | 99-6191-252 | A | C | S | 5698 | 9629 |
| 1765 | 99-6193-88 | C | T | S | 5699 | 9630 |
| 1766 | 99-621-215 | A | G | A | 5700 | 9631 |
| 1767 | 99-6217-420 | C | T | S | 5701 | 9632 |
| 1768 | 99-622-95 | A | G | A | 5702 | 9633 |
| 1769 | 99-6253-308 | C | T | S | 5703 | 9634 |
| 1770 | 99-6257-226 | C | T | S | 5704 | 9635 |
| 1771 | 99-6261-172 | A | C | S | 5705 | 9636 |
| 1772 | 99-6278-391 | C | T | S | 5706 | 9637 |
| 1773 | 99-6294-184 | C | T | S | 5707 | 9638 |
| 1774 | 99-6298-280 | A | C | S | 5708 | 9639 |
| 1775 | 99-6300-106 | G | C | S | 5709 | 9640 |
| 1776 | 99-6310-217 | G | C | S | 5710 | 9641 |
| 1777 | 99-632-173 | C | T | S | 5711 | 9642 |
| 1778 | 99-6327-270 | A | C | S | 5712 | 9643 |
| 1779 | 99-6332-143 | C | T | S | 5713 | 9644 |
| 1780 | 99-6367-268 | A | C | S | 5714 | 9645 |
| 1781 | 99-6368-426 | A | G | A | 5715 | 9646 |
| 1782 | 99-6404-147 | A | G | A | 5716 | 9647 |
| 1783 | 99-6409-62 | C | T | S | 5717 | 9648 |
| 1784 | 99-6411-93 | A | G | A | 5718 | 9649 |
| 1785 | 99-6413-369 | C | T | S | 5719 | 9650 |
| 1786 | 99-6415-279 | C | T | S | 5720 | 9651 |
| 1787 | 99-6421-210 | C | T | S | 5721 | 9652 |

TABLE 1-continued

| SEQ ID No. | Marker Name | Preferred Allele 1ST | 2ND | microseq. primer | Amplification primer Upstream (PU) | Downstream (RP) |
|---|---|---|---|---|---|---|
| 1788 | 99-6423-90 | G | C | S | 5722 | 9653 |
| 1789 | 99-6426-413 | A | G | A | 5723 | 9654 |
| 1790 | 99-6427-190 | A | G | A | 5724 | 9655 |
| 1791 | 99-6435-343 | A | G | A | 5725 | 9656 |
| 1792 | 99-6437-77 | A | C | S | 5726 | 9657 |
| 1793 | 99-6440-318 | G | C | S | 5727 | 9658 |
| 1794 | 99-6447-178 | C | T | S | 5728 | 9659 |
| 1795 | 99-6456-165 | C | T | S | 5729 | 9660 |
| 1796 | 99-6459-201 | A | G | A | 5730 | 9661 |
| 1797 | 99-646-271 | C | T | S | 5731 | 9662 |
| 1798 | 99-6463-348 | A | C | S | 5732 | 9663 |
| 1799 | 99-6468-288 | A | G | A | 5733 | 9664 |
| 1800 | 99-6478-358 | A | G | A | 5734 | 9665 |
| 1801 | 99-6480-440 | A | G | A | 5735 | 9666 |
| 1802 | 99-6489-237 | G | T | A | 5736 | 9667 |
| 1803 | 99-649-422 | A | T | S | 5737 | 9668 |
| 1804 | 99-6496-340 | A | G | A | 5738 | 9669 |
| 1805 | 99-6511-176 | C | T | S | 5739 | 9670 |
| 1806 | 99-6525-196 | C | T | S | 5740 | 9671 |
| 1807 | 99-6527-95 | A | C | S | 5741 | 9672 |
| 1808 | 99-6529-519 | C | T | S | 5742 | 9673 |
| 1809 | 99-6539-298 | A | G | A | 5743 | 9674 |
| 1810 | 99-6557-401 | A | G | A | 5744 | 9675 |
| 1811 | 99-658-367 | A | G | A | 5745 | 9676 |
| 1812 | 99-6581-45 | C | T | S | 5746 | 9677 |
| 1813 | 99-6586-359 | A | G | A | 5747 | 9678 |
| 1814 | 99-6588-94 | C | T | S | 5748 | 9679 |
| 1815 | 99-6595-322 | G | C | S | 5749 | 9680 |
| 1816 | 99-6609-103 | C | T | S | 5750 | 9681 |
| 1817 | 99-6612-185 | G | T | A | 5751 | 9682 |
| 1818 | 99-6613-223 | G | C | S | 5752 | 9683 |
| 1819 | 99-6620-294 | A | C | S | 5753 | 9684 |
| 1820 | 99-6628-474 | A | C | S | 5754 | 9685 |
| 1821 | 99-6639-290 | C | T | S | 5755 | 9686 |
| 1822 | 99-6640-342 | A | T | S | 5756 | 9687 |
| 1823 | 99-6646-465 | A | G | A | 5757 | 9688 |
| 1824 | 99-6667-63 | C | T | S | 5758 | 9689 |
| 1825 | 99-6672-314 | G | T | A | 5759 | 9690 |
| 1826 | 99-6675-324 | A | G | A | 5760 | 9691 |
| 1827 | 99-6688-363 | A | G | A | 5761 | 9692 |
| 1828 | 99-669-291 | A | C | S | 5762 | 9693 |
| 1829 | 99-6697-80 | A | T | S | 5763 | 9694 |
| 1830 | 99-670-274 | A | G | A | 5764 | 9695 |
| 1831 | 99-6705-101 | C | T | S | 5765 | 9696 |
| 1832 | 99-6706-308 | C | T | S | 5766 | 9697 |
| 1833 | 99-6715-439 | C | T | S | 5767 | 9698 |
| 1834 | 99-6726-341 | A | T | S | 5768 | 9699 |
| 1835 | 99-6730-356 | A | G | A | 5769 | 9700 |
| 1836 | 99-6753-79 | A | C | S | 5770 | 9701 |
| 1837 | 99-6757-288 | G | T | A | 5771 | 9702 |
| 1838 | 99-676-357 | A | G | A | 5772 | 9703 |
| 1839 | 99-6781-263 | G | T | A | 5773 | 9704 |
| 1840 | 99-6790-378 | C | T | S | 5774 | 9705 |
| 1841 | 99-680-228 | A | G | A | 5775 | 9706 |
| 1842 | 99-6804-426 | A | G | A | 5776 | 9707 |
| 1843 | 99-6815-484 | G | C | S | 5777 | 9708 |
| 1844 | 99-6820-251 | A | G | A | 5778 | 9709 |
| 1845 | 99-6832-178 | C | T | S | 5779 | 9710 |
| 1846 | 99-6856-433 | A | G | A | 5780 | 9711 |
| 1847 | 99-6865-455 | C | T | S | 5781 | 9712 |
| 1848 | 99-6866-130 | A | G | A | 5782 | 9713 |
| 1849 | 99-6869-256 | A | G | A | 5783 | 9714 |
| 1850 | 99-6876-229 | C | T | S | 5784 | 9715 |
| 1851 | 99-689-219 | C | T | S | 5785 | 9716 |
| 1852 | 99-6893-392 | C | T | S | 5786 | 9717 |
| 1853 | 99-6895-144 | A | T | S | 5787 | 9718 |
| 1854 | 99-6938-347 | G | T | A | 5788 | 9719 |
| 1855 | 99-694-236 | G | T | A | 5789 | 9720 |
| 1856 | 99-6940-464 | A | G | A | 5790 | 9721 |
| 1857 | 99-6942-313 | A | C | S | 5791 | 9722 |
| 1858 | 99-6951-410 | G | T | A | 5792 | 9723 |
| 1859 | 99-6956-58 | C | T | S | 5793 | 9724 |
| 1860 | 99-6957-137 | G | C | S | 5794 | 9725 |
| 1861 | 99-6960-412 | A | T | S | 5795 | 9726 |
| 1862 | 99-6962-34 | G | C | S | 5796 | 9727 |
| 1863 | 99-6979-64 | C | T | S | 5797 | 9728 |
| 1864 | 99-6986-157 | A | G | A | 5798 | 9729 |
| 1865 | 99-6988-236 | A | C | S | 5799 | 9730 |
| 1866 | 99-6989-397 | A | G | A | 5800 | 9731 |
| 1867 | 99-6996-217 | C | T | S | 5801 | 9732 |
| 1868 | 99-700-123 | A | G | A | 5802 | 9733 |
| 1869 | 99-7000-235 | G | C | S | 5803 | 9734 |
| 1870 | 99-7004-304 | A | G | A | 5804 | 9735 |
| 1871 | 99-7013-250 | C | T | S | 5805 | 9736 |
| 1872 | 99-7024-122 | G | T | A | 5806 | 9737 |
| 1873 | 99-7025-226 | C | T | S | 5807 | 9738 |
| 1874 | 99-7026-247 | C | T | S | 5808 | 9739 |
| 1875 | 99-7047-225 | C | T | S | 5809 | 9740 |
| 1876 | 99-7056-49 | A | G | A | 5810 | 9741 |
| 1877 | 99-708-243 | C | T | S | 5811 | 9742 |
| 1878 | 99-7084-187 | C | T | S | 5812 | 9743 |
| 1879 | 99-7090-294 | A | G | A | 5813 | 9744 |
| 1880 | 99-7093-36 | A | C | S | 5814 | 9745 |
| 1881 | 99-7098-382 | A | G | A | 5815 | 9746 |
| 1882 | 99-7103-155 | C | T | S | 5816 | 9747 |
| 1883 | 99-7104-187 | A | G | A | 5817 | 9748 |
| 1884 | 99-7107-143 | A | G | A | 5818 | 9749 |
| 1885 | 99-7114-31 | A | G | A | 5819 | 9750 |
| 1886 | 99-7119-278 | A | G | A | 5820 | 9751 |
| 1887 | 99-7129-335 | A | C | S | 5821 | 9752 |
| 1888 | 99-7131-259 | C | T | S | 5822 | 9753 |
| 1889 | 99-7136-329 | C | T | S | 5823 | 9754 |
| 1890 | 99-7137-420 | C | T | S | 5824 | 9755 |
| 1891 | 99-7140-355 | A | G | A | 5825 | 9756 |
| 1892 | 99-7141-395 | A | G | A | 5826 | 9757 |
| 1893 | 99-7144-261 | C | j | S | 5827 | 9758 |
| 1894 | 99-7148-262 | C | T | S | 5828 | 9759 |
| 1895 | 99-7167-438 | A | G | A | 5829 | 9760 |
| 1896 | 99-7172-441 | A | G | A | 5830 | 9761 |
| 1897 | 99-7177-81 | C | T | S | 5831 | 9762 |
| 1898 | 99-718-261 | A | G | A | 5832 | 9763 |
| 1899 | 99-7183-338 | A | G | A | 5833 | 9764 |
| 1900 | 99-7193-228 | G | C | S | 5834 | 9765 |
| 1901 | 99-72-109 | C | T | S | 5835 | 9766 |
| 1902 | 99-7212-346 | C | T | S | 5836 | 9767 |
| 1903 | 99-7214-109 | C | T | S | 5837 | 9768 |
| 1904 | 99-7218-444 | C | T | S | 5838 | 9769 |
| 1905 | 99-7234-101 | A | T | S | 5839 | 9770 |
| 1906 | 99-724-246 | A | G | A | 5840 | 9771 |
| 1907 | 99-7252-279 | C | T | S | 5841 | 9772 |
| 1908 | 99-7274-172 | C | T | S | 5842 | 9773 |
| 1909 | 99-7275-150 | C | T | S | 5843 | 9774 |
| 1910 | 99-7276-286 | A | G | A | 5844 | 9775 |
| 1911 | 99-7293-201 | A | G | A | 5845 | 9776 |
| 1912 | 99-73-140 | C | T | S | 5846 | 9777 |
| 1913 | 99-7311-179 | A | G | A | 5847 | 9778 |
| 1914 | 99-7312-177 | A | G | A | 5848 | 9779 |
| 1915 | 99-7323-178 | A | C | S | 5849 | 9780 |
| 1916 | 99-7326-94 | G | C | S | 5850 | 9781 |
| 1917 | 99-7334-350 | C | T | S | 5851 | 9782 |
| 1918 | 99-734-126 | C | T | S | 5852 | 9783 |
| 1919 | 99-7349-384 | G | C | S | 5853 | 9784 |
| 1920 | 99-7356-176 | A | G | A | 5854 | 9785 |
| 1921 | 99-7363-474 | C | T | S | 5855 | 9786 |
| 1922 | 99-737-372 | A | G | A | 5856 | 9787 |
| 1923 | 99-7373-339 | A | G | A | 5857 | 9788 |
| 1924 | 99-7374-230 | A | G | A | 5858 | 9789 |
| 1925 | 99-7375-210 | C | T | S | 5859 | 9790 |
| 1926 | 99-7376-157 | A | T | S | 5860 | 9791 |
| 1927 | 99-7380-255 | A | G | A | 5861 | 9792 |
| 1928 | 99-7387-414 | C | T | S | 5862 | 9793 |
| 1929 | 99-7391-356 | C | T | S | 5863 | 9794 |
| 1930 | 99-7396-228 | A | T | S | 5864 | 9795 |
| 1931 | 99-7402-110 | C | T | S | 5865 | 9796 |
| 1932 | 99-7405-92 | C | T | S | 5866 | 9797 |
| 1933 | 99-7406-380 | A | G | A | 5867 | 9798 |

TABLE 1-continued

| SEQ ID No. | Marker Name | Preferred Allele 1ST | 2ND | microseq. primer | Amplification primer Upstream (PU) | Downstream (RP) |
|---|---|---|---|---|---|---|
| 1934 | 99-7417-440 | C | T | S | 5868 | 9799 |
| 1935 | 99-7429-204 | G | T | A | 5869 | 9800 |
| 1936 | 99-7447-281 | G | C | S | 5870 | 9801 |
| 1937 | 99-7453-405 | C | T | S | 5871 | 9802 |
| 1938 | 99-7454-35 | G | C | S | 5872 | 9803 |
| 1939 | 99-747-252 | A | G | A | 5873 | 9804 |
| 1940 | 99-7475-179 | G | T | A | 5874 | 9805 |
| 1941 | 99-7480-66 | A | G | A | 5875 | 9806 |
| 1942 | 99-7492-275 | C | T | S | 5876 | 9807 |
| 1943 | 99-7493-249 | G | C | S | 5877 | 9808 |
| 1944 | 99-7502-382 | A | T | S | 5878 | 9809 |
| 1945 | 99-7504-342 | A | C | S | 5879 | 9810 |
| 1946 | 99-7520-222 | A | G | A | 5880 | 9811 |
| 1947 | 99-7524-130 | A | G | A | 5881 | 9812 |
| 1948 | 99-7543-467 | A | G | A | 5882 | 9813 |
| 1949 | 99-755-83 | A | T | S | 5883 | 9814 |
| 1950 | 99-7598-388 | A | G | A | 5884 | 9815 |
| 1951 | 99-760-261 | C | T | S | 5885 | 9816 |
| 1952 | 99-7604-309 | A | G | A | 5886 | 9817 |
| 1953 | 99-7605-62 | G | C | S | 5887 | 9818 |
| 1954 | 99-7608-388 | C | T | S | 5888 | 9819 |
| 1955 | 99-7610-444 | C | T | S | 5889 | 9820 |
| 1956 | 99-7611-156 | A | G | A | 5890 | 9821 |
| 1957 | 99-7614-28 | A | T | S | 5891 | 9822 |
| 1958 | 99-763-240 | A | G | A | 5892 | 9823 |
| 1959 | 99-7642-191 | A | G | A | 5893 | 9824 |
| 1960 | 99-7643-350 | C | T | S | 5894 | 9825 |
| 1961 | 99-7650-187 | G | C | S | 5895 | 9826 |
| 1962 | 99-7671-33 | G | C | S | 5896 | 9827 |
| 1963 | 99-7677-107 | C | T | S | 5897 | 9828 |
| 1964 | 99-7688-325 | C | T | S | 5898 | 9829 |
| 1965 | 99-7692-340 | A | G | A | 5899 | 9830 |
| 1966 | 99-77-318 | A | C | A | 5900 | 9831 |
| 1967 | 99-7706-303 | A | G | A | 5901 | 9832 |
| 1968 | 99-771-391 | A | G | A | 5902 | 9833 |
| 1969 | 99-7710-318 | C | T | S | 5903 | 9834 |
| 1970 | 99-7712-176 | C | T | S | 5904 | 9835 |
| 1971 | 99-7721-379 | A | C | A | 5905 | 9836 |
| 1972 | 99-7727-65 | C | T | S | 5906 | 9837 |
| 1973 | 99-7728-334 | A | G | A | 5907 | 9838 |
| 1974 | 99-7732-122 | C | T | S | 5908 | 9839 |
| 1975 | 99-7737-264 | A | G | A | 5909 | 9840 |
| 1976 | 99-7744-255 | G | C | S | 5910 | 9841 |
| 1977 | 99-7745-305 | G | C | S | 5911 | 9842 |
| 1978 | 99-7749-123 | C | T | S | 5912 | 9843 |
| 1979 | 99-7751-450 | A | G | A | 5913 | 9844 |
| 1980 | 99-7753-199 | G | C | S | 5914 | 9845 |
| 1981 | 99-7754-119 | G | T | A | 5915 | 9846 |
| 1982 | 99-7759-63 | G | T | A | 5916 | 9847 |
| 1983 | 99-7762-227 | A | G | A | 5917 | 9848 |
| 1984 | 99-7764-161 | A | G | A | 5918 | 9849 |
| 1985 | 99-7775-313 | C | T | A | 5919 | 9850 |
| 1986 | 99-7784-31 | C | T | S | 5920 | 9851 |
| 1987 | 99-7789-404 | G | T | A | 5921 | 9852 |
| 1988 | 99-7792-173 | C | T | A | 5922 | 9853 |
| 1989 | 99-7796-130 | G | C | S | 5923 | 9854 |
| 1990 | 99-7803-253 | A | G | A | 5924 | 9855 |
| 1991 | 99-781-64 | A | G | A | 5925 | 9856 |
| 1992 | 99-7840-281 | A | C | S | 5926 | 9857 |
| 1993 | 99-785-360 | A | G | A | 5927 | 9858 |
| 1994 | 99-7868-204 | A | G | A | 5928 | 9859 |
| 1995 | 99-7869-135 | G | C | S | 5929 | 9860 |
| 1996 | 99-7870-316 | A | C | S | 5930 | 9861 |
| 1997 | 99-7877-363 | A | G | A | 5931 | 9862 |
| 1998 | 99-7882-43 | A | G | A | 5932 | 9863 |
| 1999 | 99-7883-411 | G | C | S | 5933 | 9864 |
| 2000 | 99-7884-151 | G | T | A | 5934 | 9865 |
| 2001 | 99-7893-226 | A | G | A | 5935 | 9866 |
| 2002 | 99-7898-43 | A | T | S | 5936 | 9867 |
| 2003 | 99-7900-452 | A | G | A | 5937 | 9868 |
| 2004 | 99-791-236 | C | T | S | 5938 | 9869 |
| 2005 | 99-7917-429 | A | C | S | 5939 | 9870 |
| 2006 | 99-794-393 | G | C | S | 5940 | 9871 |
| 2007 | 99-7949-301 | A | G | A | 5941 | 9872 |
| 2008 | 99-795-211 | C | T | S | 5942 | 9873 |
| 2009 | 99-7967-152 | C | T | S | 5943 | 9874 |
| 2010 | 99-797-238 | C | T | S | 5944 | 9875 |
| 2011 | 99-7985-178 | G | C | S | 5945 | 9876 |
| 2012 | 99-7988-389 | C | T | S | 5946 | 9877 |
| 2013 | 99-8002-49 | A | G | A | 5947 | 9878 |
| 2014 | 99-8010-124 | C | T | S | 5948 | 9879 |
| 2015 | 99-8012-420 | A | G | A | 5949 | 9880 |
| 2016 | 99-8013-122 | A | G | A | 5950 | 9881 |
| 2017 | 99-8016-267 | A | G | A | 5951 | 9882 |
| 2018 | 99-8025-306 | A | C | S | 5952 | 9883 |
| 2019 | 99-8027-265 | C | T | S | 5953 | 9884 |
| 2020 | 99-8028-87 | A | T | S | 5954 | 9885 |
| 2021 | 99-8030-411 | G | C | S | 5955 | 9886 |
| 2022 | 99-8046-263 | A | G | A | 5956 | 9887 |
| 2023 | 99-8051-125 | A | G | A | 5957 | 9888 |
| 2024 | 99-806-152 | C | T | S | 5958 | 9889 |
| 2025 | 99-8063-174 | C | T | S | 5959 | 9890 |
| 2026 | 99-8067-79 | A | G | A | 5960 | 9891 |
| 2027 | 99-8068-258 | C | T | S | 5961 | 9892 |
| 2028 | 99-8081-340 | C | T | S | 5962 | 9893 |
| 2029 | 99-8088-247 | A | C | S | 5963 | 9894 |
| 2030 | 99-8089-246 | A | G | A | 5964 | 9895 |
| 2031 | 99-8095-164 | G | T | A | 5965 | 9896 |
| 2032 | 99-81-227 | C | T | S | 5966 | 9897 |
| 2033 | 99-810-117 | A | G | A | 5967 | 9898 |
| 2034 | 99-8102-124 | C | T | S | 5968 | 9899 |
| 2035 | 99-8120-354 | A | G | A | 5969 | 9900 |
| 2036 | 99-8128-302 | C | T | S | 5970 | 9901 |
| 2037 | 99-8141-65 | A | C | S | 5971 | 9902 |
| 2038 | 99-8161-230 | A | G | A | 5972 | 9903 |
| 2039 | 99-8162-210 | C | T | S | 5973 | 9904 |
| 2040 | 99-8164-397 | A | G | S | 5974 | 9905 |
| 2041 | 99-8170-163 | C | T | S | 5975 | 9906 |
| 2042 | 99-8173-352 | C | T | S | 5976 | 9907 |
| 2043 | 99-8181-228 | A | T | S | 5977 | 9908 |
| 2044 | 99-8186-76 | G | T | A | 5978 | 9909 |
| 2045 | 99-8188-369 | G | T | A | 5979 | 9910 |
| 2046 | 99-8192-168 | C | T | S | 5980 | 9911 |
| 2047 | 99-8219-373 | A | G | A | 5981 | 9912 |
| 2048 | 99-8245-192 | G | C | S | 5982 | 9913 |
| 2049 | 99-8255-365 | A | G | A | 5983 | 9914 |
| 2050 | 99-8256-148 | A | G | A | 5984 | 9915 |
| 2051 | 99-8266-393 | A | G | A | 5985 | 9916 |
| 2052 | 99-827-359 | C | T | S | 5986 | 9917 |
| 2053 | 99-8272-122 | G | C | S | 5987 | 9918 |
| 2054 | 99-8276-65 | A | C | S | 5988 | 9919 |
| 2055 | 99-8278-412 | A | G | A | 5989 | 9920 |
| 2056 | 99-8279-252 | A | T | S | 5990 | 9921 |
| 2057 | 99-828-259 | C | T | S | 5991 | 9922 |
| 2058 | 99-8287-122 | A | C | S | 5992 | 9923 |
| 2059 | 99-8289-179 | G | C | S | 5993 | 9924 |
| 2060 | 99-8290-174 | A | G | A | 5994 | 9925 |
| 2061 | 99-8292-240 | A | G | A | 5995 | 9926 |
| 2062 | 99-8294-408 | A | G | A | 5996 | 9927 |
| 2063 | 99-8308-237 | A | C | S | 5997 | 9928 |
| 2064 | 99-8313-107 | A | G | A | 5998 | 9929 |
| 2065 | 99-8318-50 | A | G | A | 5999 | 9930 |
| 2066 | 99-8328-298 | C | T | S | 6000 | 9931 |
| 2067 | 99-8338-212 | G | C | S | 6001 | 9932 |
| 2068 | 99-8340-364 | C | T | S | 6002 | 9933 |
| 2069 | 99-8341-99 | A | G | A | 6003 | 9934 |
| 2070 | 99-8342-33 | A | C | S | 6004 | 9935 |
| 2071 | 99-8353-291 | A | C | S | 6005 | 9936 |
| 2072 | 99-8360-401 | C | T | S | 6006 | 9937 |
| 2073 | 99-8361-103 | C | T | S | 6007 | 9938 |
| 2074 | 99-8367-239 | C | T | S | 6008 | 9939 |
| 2075 | 99-8369-276 | G | T | A | 6009 | 9940 |
| 2076 | 99-8377-429 | C | T | S | 6010 | 9941 |
| 2077 | 99-8378-69 | A | G | A | 6011 | 9942 |
| 2078 | 99-8379-337 | C | T | S | 6012 | 9943 |
| 2079 | 99-8381-114 | C | T | S | 6013 | 9944 |

TABLE 1-continued

| SEQ ID No. | Marker Name | Allele 1ST | Allele 2ND | Preferred microseq. primer | Amplification primer Upstream (PU) | Amplification primer Downstream (RP) |
|---|---|---|---|---|---|---|
| 2080 | 99-8383-158 | G | T | A | 6014 | 9945 |
| 2081 | 99-8385-244 | A | G | A | 6015 | 9946 |
| 2082 | 99-840-68 | A | C | S | 6016 | 9947 |
| 2083 | 99-8402-113 | G | C | S | 6017 | 9948 |
| 2084 | 99-8414-183 | A | T | S | 6018 | 9949 |
| 2085 | 99-8441-298 | A | C | S | 6019 | 9950 |
| 2086 | 99-8442-95 | C | T | S | 6020 | 9951 |
| 2087 | 99-8453-358 | A | G | A | 6021 | 9952 |
| 2088 | 99-8454-152 | C | T | S | 6022 | 9953 |
| 2089 | 99-8456-266 | A | C | S | 6023 | 9954 |
| 2090 | 99-8457-239 | C | T | S | 6024 | 9955 |
| 2091 | 99-8470-275 | A | G | A | 6025 | 9956 |
| 2092 | 99-8472-152 | G | C | S | 6026 | 9957 |
| 2093 | 99-8476-216 | A | G | A | 6027 | 9958 |
| 2094 | 99-8478-385 | G | T | A | 6028 | 9959 |
| 2095 | 99-8487-245 | C | T | S | 6029 | 9960 |
| 2096 | 99-8491-339 | A | G | A | 6030 | 9961 |
| 2097 | 99-8499-107 | C | T | S | 6031 | 9962 |
| 2098 | 99-8505-269 | A | G | A | 6032 | 9963 |
| 2099 | 99-851-237 | C | T | S | 6033 | 9964 |
| 2100 | 99-8510-44 | A | C | S | 6034 | 9965 |
| 2101 | 99-8514-434 | C | T | S | 6035 | 9966 |
| 2102 | 99-8530-209 | A | G | A | 6036 | 9967 |
| 2103 | 99-854-415 | C | T | S | 6037 | 9968 |
| 2104 | 99-8546-116 | C | T | S | 6038 | 9969 |
| 2105 | 99-8571-396 | A | G | A | 6039 | 9970 |
| 2106 | 99-8575-401 | C | T | S | 6040 | 9971 |
| 2107 | 99-8576-321 | A | G | A | 6041 | 9972 |
| 2108 | 99-8578-407 | A | C | S | 6042 | 9973 |
| 2109 | 99-8581-443 | C | T | S | 6043 | 9974 |
| 2110 | 99-8583-146 | A | C | S | 6044 | 9975 |
| 2111 | 99-8588-369 | A | G | A | 6045 | 9976 |
| 2112 | 99-8590-287 | A | G | A | 6046 | 9977 |
| 2113 | 99-860-419 | C | T | S | 6047 | 9978 |
| 2114 | 99-8600-393 | A | T | S | 6048 | 9979 |
| 2115 | 99-8609-434 | G | T | A | 6049 | 9980 |
| 2116 | 99-8611-383 | A | G | A | 6050 | 9981 |
| 2117 | 99-862-233 | A | C | S | 6051 | 9982 |
| 2118 | 99-8626-133 | C | T | S | 6052 | 9983 |
| 2119 | 99-8632-413 | A | G | A | 6053 | 9984 |
| 2120 | 99-8638-107 | C | T | S | 6054 | 9985 |
| 2121 | 99-8641-418 | C | T | S | 6055 | 9986 |
| 2122 | 99-8648-169 | A | T | S | 6056 | 9987 |
| 2123 | 99-8654-157 | A | G | A | 6057 | 9988 |
| 2124 | 99-8655-77 | C | T | S | 6058 | 9989 |
| 2125 | 99-8658-168 | A | G | A | 6059 | 9990 |
| 2126 | 99-866-160 | C | T | S | 6060 | 9991 |
| 2127 | 99-8662-192 | A | C | S | 6061 | 9992 |
| 2128 | 99-8663-39 | C | T | S | 6062 | 9993 |
| 2129 | 99-8665-182 | A | C | S | 6063 | 9994 |
| 2130 | 99-8671-143 | A | G | A | 6064 | 9995 |
| 2131 | 99-8695-147 | A | T | S | 6065 | 9996 |
| 2132 | 99-870-379 | C | T | S | 6066 | 9997 |
| 2133 | 99-8703-42 | C | T | S | 6067 | 9998 |
| 2134 | 99-8715-315 | A | G | A | 6068 | 9999 |
| 2135 | 99-8725-240 | A | G | A | 6069 | 10000 |
| 2136 | 99-8732-105 | A | G | A | 6070 | 10001 |
| 2137 | 99-8744-283 | A | G | A | 6071 | 10002 |
| 2138 | 99-8748-239 | C | T | S | 6072 | 10003 |
| 2139 | 99-8755-402 | C | T | S | 6073 | 10004 |
| 2140 | 99-8761-163 | A | G | A | 6074 | 10005 |
| 2141 | 99-8775-410 | C | T | S | 6075 | 10006 |
| 2142 | 99-8778-416 | A | G | A | 6076 | 10007 |
| 2143 | 99-8780-454 | C | T | S | 6077 | 10008 |
| 2144 | 99-8796-142 | G | T | A | 6078 | 10009 |
| 2145 | 99-8799-211 | A | G | A | 6079 | 10010 |
| 2146 | 99-88-216 | A | G | S | 6080 | 10011 |
| 2147 | 99-8800-250 | C | T | S | 6081 | 10012 |
| 2148 | 99-8802-119 | A | G | A | 6082 | 10013 |
| 2149 | 99-8804-83 | A | C | S | 6083 | 10014 |
| 2150 | 99-8812-220 | A | G | A | 6084 | 10015 |
| 2151 | 99-8827-400 | C | T | S | 6085 | 10016 |
| 2152 | 99-8831-41 | C | T | S | 6086 | 10017 |
| 2153 | 99-8835-400 | A | G | A | 6087 | 10018 |
| 2154 | 99-8849-167 | A | G | A | 6088 | 10019 |
| 2155 | 99-8857-96 | A | T | S | 6089 | 10020 |
| 2156 | 99-8866-150 | A | G | S | 6090 | 10021 |
| 2157 | 99-8867-278 | A | T | S | 6091 | 10022 |
| 2158 | 99-8872-391 | A | T | S | 6092 | 10023 |
| 2159 | 99-8885-447 | A | G | A | 6093 | 10024 |
| 2160 | 99-8887-397 | A | G | A | 6094 | 10025 |
| 2161 | 99-8894-123 | A | G | A | 6095 | 10026 |
| 2162 | 99-8895-272 | A | T | S | 6096 | 10027 |
| 2163 | 99-8901-283 | A | G | A | 6097 | 10028 |
| 2164 | 99-8905-184 | G | C | S | 6098 | 10029 |
| 2165 | 99-8910-170 | C | T | S | 6099 | 10030 |
| 2166 | 99-8923-138 | C | T | S | 6100 | 10031 |
| 2167 | 99-8924-415 | A | T | S | 6101 | 10032 |
| 2168 | 99-8960-426 | A | C | S | 6102 | 10033 |
| 2169 | 99-8963-409 | A | C | S | 6103 | 10034 |
| 2170 | 99-8974-386 | C | T | S | 6104 | 10035 |
| 2171 | 99-8978-52 | A | G | A | 6105 | 10036 |
| 2172 | 99-8992-43 | A | G | A | 6106 | 10037 |
| 2173 | 99-9015-255 | A | G | A | 6107 | 10038 |
| 2174 | 99-9020-110 | G | T | A | 6108 | 10039 |
| 2175 | 99-9026-273 | A | G | A | 6109 | 10040 |
| 2176 | 99-9029-132 | A | G | A | 6110 | 10041 |
| 2177 | 99-9047-183 | A | G | A | 6111 | 10042 |
| 2178 | 99-9053-311 | A | C | S | 6112 | 10043 |
| 2179 | 99-9059-197 | A | T | S | 6113 | 10044 |
| 2180 | 99-9061-309 | A | G | A | 6114 | 10045 |
| 2181 | 99-9064-194 | A | G | A | 6115 | 10046 |
| 2182 | 99-9079-158 | A | G | A | 6116 | 10047 |
| 2183 | 99-9084-200 | A | G | A | 6117 | 10048 |
| 2184 | 99-9092-167 | A | G | A | 6118 | 10049 |
| 2185 | 99-9097-342 | A | G | A | 6119 | 10050 |
| 2186 | 99-9105-68 | G | T | A | 6120 | 10051 |
| 2187 | 99-9118-393 | C | T | S | 6121 | 10052 |
| 2188 | 99-9120-197 | C | T | S | 6122 | 10053 |
| 2189 | 99-9126-25 | G | C | S | 6123 | 10054 |
| 2190 | 99-913-140 | A | G | A | 6124 | 10055 |
| 2191 | 99-9141-307 | G | C | S | 6125 | 10056 |
| 2192 | 99-9152-154 | C | T | S | 6126 | 10057 |
| 2193 | 99-9157-329 | A | C | S | 6127 | 10058 |
| 2194 | 99-9175-329 | A | G | A | 6128 | 10059 |
| 2195 | 99-9204-245 | C | T | S | 6129 | 10060 |
| 2196 | 99-921-285 | C | T | S | 6130 | 10061 |
| 2197 | 99-924-93 | A | G | A | 6131 | 10062 |
| 2198 | 99-9240-109 | C | T | S | 6132 | 10063 |
| 2199 | 99-9250-450 | G | T | A | 6133 | 10064 |
| 2200 | 99-9254-404 | A | G | A | 6134 | 10065 |
| 2201 | 99-926-98 | G | T | A | 6135 | 10066 |
| 2202 | 99-9263-283 | A | G | A | 6136 | 10067 |
| 2203 | 99-9271-70 | G | T | A | 6137 | 10068 |
| 2204 | 99-9274-246 | C | T | S | 6138 | 10069 |
| 2205 | 99-9276-163 | C | T | S | 6139 | 10070 |
| 2206 | 99-9355-134 | C | T | S | 6140 | 10071 |
| 2207 | 99-9368-223 | A | G | A | 6141 | 10072 |
| 2208 | 99-937-125 | A | T | S | 6142 | 10073 |
| 2209 | 99-9372-298 | A | C | S | 6143 | 10074 |
| 2210 | 99-9381-429 | A | G | A | 6144 | 10075 |
| 2211 | 99-9385-387 | C | T | S | 6145 | 10076 |
| 2212 | 99-9389-363 | A | G | A | 6146 | 10077 |
| 2213 | 99-9395-133 | C | T | S | 6147 | 10078 |
| 2214 | 99-9401-80 | A | G | A | 6148 | 10079 |
| 2215 | 99-9402-263 | C | T | S | 6149 | 10080 |
| 2216 | 99-9404-338 | A | T | S | 6150 | 10081 |
| 2217 | 99-9405-421 | A | G | A | 6151 | 10082 |
| 2218 | 99-941-265 | A | T | S | 6152 | 10083 |
| 2219 | 99-9410-205 | C | T | S | 6153 | 10084 |
| 2220 | 99-9412-202 | C | T | S | 6154 | 10085 |
| 2221 | 99-9417-151 | C | T | S | 6155 | 10086 |
| 2222 | 99-942-381 | C | T | S | 6156 | 10087 |
| 2223 | 99-9420-318 | C | T | S | 6157 | 10088 |
| 2224 | 99-9421-51 | A | G | A | 6158 | 10089 |
| 2225 | 99-9422-41 | A | G | A | 6159 | 10090 |

TABLE 1-continued

| SEQ ID No. | Marker Name | Allele 1ST | Allele 2ND | Preferred microseq. primer | Amplification primer Upstream (PU) | Amplification primer Downstream (RP) |
|---|---|---|---|---|---|---|
| 2226 | 99-9423-394 | A | G | A | 6160 | 10091 |
| 2227 | 99-9424-229 | A | G | A | 6161 | 10092 |
| 2228 | 99-9427-454 | C | T | S | 6162 | 10093 |
| 2229 | 99-9446-394 | A | G | A | 6163 | 10094 |
| 2230 | 99-9448-292 | C | T | S | 6164 | 10095 |
| 2231 | 99-9462-362 | A | G | A | 6165 | 10096 |
| 2232 | 99-9471-230 | A | G | A | 6166 | 10097 |
| 2233 | 99-949-214 | A | G | A | 6167 | 10098 |
| 2234 | 99-9491-388 | A | G | A | 6168 | 10099 |
| 2235 | 99-9493-455 | G | C | S | 6169 | 10100 |
| 2236 | 99-9499-111 | A | T | S | 6170 | 10101 |
| 2237 | 99-950-418 | C | T | S | 6171 | 10102 |
| 2238 | 99-9513-285 | A | G | A | 6172 | 10103 |
| 2239 | 99-952-252 | G | C | S | 6173 | 10104 |
| 2240 | 99-9527-211 | C | T | S | 6174 | 10105 |
| 2241 | 99-9531-340 | C | T | S | 6175 | 10106 |
| 2242 | 99-9538-395 | A | G | A | 6176 | 10107 |
| 2243 | 99-954-45 | A | C | S | 6177 | 10108 |
| 2244 | 99-9542-164 | G | T | A | 6178 | 10109 |
| 2245 | 99-9545-100 | A | C | S | 6179 | 10110 |
| 2246 | 99-9554-345 | A | C | S | 6180 | 10111 |
| 2247 | 99-9555-348 | C | T | S | 6181 | 10112 |
| 2248 | 99-9556-349 | A | G | A | 6182 | 10113 |
| 2249 | 99-9567-229 | C | T | A | 6183 | 10114 |
| 2250 | 99-9572-240 | C | T | A | 6184 | 10115 |
| 2251 | 99-9577-284 | C | T | A | 6185 | 10116 |
| 2252 | 99-9579-363 | G | C | S | 6186 | 10117 |
| 2253 | 99-958-92 | C | T | A | 6187 | 10118 |
| 2254 | 99-9587-338 | A | G | S | 6188 | 10119 |
| 2255 | 99-961-150 | C | T | S | 6189 | 10120 |
| 2256 | 99-963-395 | A | G | A | 6190 | 10121 |
| 2257 | 99-965-165 | C | T | S | 6191 | 10122 |
| 2258 | 99-967-306 | C | T | S | 6192 | 10123 |
| 2259 | 99-976-246 | C | T | S | 6193 | 10124 |
| 2260 | 99-979-343 | A | C | S | 6194 | 10125 |
| 2261 | 99-10000-518 | G | A | S | 6195 | 10126 |
| 2262 | 99-10016-115 | T | A | S | 6196 | 10127 |
| 2263 | 99-10027-378 | G | A | S | 6197 | 10128 |
| 2264 | 99-10028-93 | C | G | S | 6198 | 10129 |
| 2265 | 99-10031-130 | T | C | A | 6199 | 10130 |
| 2266 | 99-10046-199 | T | C | S | 6200 | 10131 |
| 2267 | 99-10064-252 | T | C | S | 6201 | 10132 |
| 2268 | 99-10066-465 | G | T | A | 6202 | 10133 |
| 2269 | 99-10067-168 | G | A | A | 6203 | 10134 |
| 2270 | 99-10078-341 | T | C | S | 6204 | 10135 |
| 2271 | 99-10104-464 | C | A | S | 6205 | 10136 |
| 2272 | 99-10106-247 | G | T | A | 6206 | 10137 |
| 2273 | 99-10108-419 | G | A | S | 6207 | 10138 |
| 2274 | 99-10118-323 | T | C | A | 6208 | 10139 |
| 2275 | 99-10126-413 | C | T | A | 6209 | 10140 |
| 2276 | 99-10127-506 | A | T | S | 6210 | 10141 |
| 2277 | 99-10137-195 | T | G | A | 6211 | 10142 |
| 2278 | 99-10142-293 | G | A | S | 6212 | 10143 |
| 2279 | 99-10143-111 | A | G | S | 6213 | 10144 |
| 2280 | 99-10146-202 | T | A | S | 6214 | 10145 |
| 2281 | 99-10149-291 | T | C | A | 6215 | 10146 |
| 2282 | 99-10151-340 | G | A | S | 6216 | 10147 |
| 2283 | 99-10153-267 | A | G | S | 6217 | 10148 |
| 2284 | 99-10155423 | C | G | S | 6218 | 10149 |
| 2285 | 99-10173-122 | A | G | S | 6219 | 10150 |
| 2286 | 99-10179-48 | G | A | S | 6220 | 10151 |
| 2287 | 99-1018-244 | A | C | A | 6221 | 10152 |
| 2288 | 99-10183-166 | G | T | A | 6222 | 10153 |
| 2289 | 99-10185-402 | C | A | S | 6223 | 10154 |
| 2290 | 99-10188-116 | G | A | S | 6224 | 10155 |
| 2291 | 99-10201-115 | C | T | A | 6225 | 10156 |
| 2292 | 99-10207-173 | A | G | S | 6226 | 10157 |
| 2293 | 99-10211-380 | A | G | S | 6227 | 10158 |
| 2294 | 99-10216-336 | A | C | S | 6228 | 10159 |
| 2295 | 99-10220-312 | C | A | S | 6229 | 10160 |
| 2296 | 99-10223-153 | T | A | S | 6230 | 10161 |
| 2297 | 99-10224-223 | T | A | S | 6231 | 10162 |
| 2298 | 99-10234-334 | A | G | S | 6232 | 10163 |
| 2299 | 99-1024-403 | G | A | S | 6233 | 10164 |
| 2300 | 99-10245-197 | A | G | S | 6234 | 10165 |
| 2301 | 99-10256-41 | A | G | S | 6235 | 10166 |
| 2302 | 99-10264-82 | G | A | S | 6236 | 10167 |
| 2303 | 99-10266-290 | T | A | S | 6237 | 10168 |
| 2304 | 99-10267-409 | A | C | S | 6238 | 10169 |
| 2305 | 99-10303-406 | C | T | A | 6239 | 10170 |
| 2306 | 99-10304-88 | A | G | S | 6240 | 10171 |
| 2307 | 99-10312-155 | C | T | A | 6241 | 10172 |
| 2308 | 99-10318-230 | C | T | A | 6242 | 10173 |
| 2309 | 99-10330-432 | G | A | S | 6243 | 10174 |
| 2310 | 99-10332-89 | C | T | A | 6244 | 10175 |
| 2311 | 99-10345-182 | T | G | A | 6245 | 10176 |
| 2312 | 99-10353-285 | G | T | A | 6246 | 10177 |
| 2313 | 99-10364-331 | A | G | S | 6247 | 10178 |
| 2314 | 99-10369-41 | T | C | A | 6248 | 10179 |
| 2315 | 99-10374-343 | C | T | A | 6249 | 10180 |
| 2316 | 99-10381-328 | T | A | S | 6250 | 10181 |
| 2317 | 99-10389-114 | G | T | A | 6251 | 10182 |
| 2318 | 99-10390-172 | A | G | S | 6252 | 10183 |
| 2319 | 99-10414-128 | C | T | A | 6253 | 10184 |
| 2320 | 99-10434-121 | G | T | S | 6254 | 10185 |
| 2321 | 99-10436-162 | C | T | A | 6255 | 10186 |
| 2322 | 99-10438-281 | C | A | S | 6256 | 10187 |
| 2323 | 99-10446-425 | G | C | S | 6257 | 10188 |
| 2324 | 99-10451-188 | A | T | S | 6258 | 10189 |
| 2325 | 99-10452-306 | A | G | S | 6259 | 10190 |
| 2326 | 99-10457-310 | T | C | A | 6260 | 10191 |
| 2327 | 99-10470-405 | A | C | S | 6261 | 10192 |
| 2328 | 99-10471-88 | C | T | A | 6262 | 10193 |
| 2329 | 99-10473-259 | T | C | A | 6263 | 10194 |
| 2330 | 99-10474-223 | G | C | S | 6264 | 10195 |
| 2331 | 99-10481-217 | C | T | A | 6265 | 10196 |
| 2332 | 99-10487-57 | T | C | A | 6266 | 10197 |
| 2333 | 99-10488-146 | G | C | S | 6267 | 10198 |
| 2334 | 99-10491-300 | C | T | A | 6268 | 10199 |
| 2335 | 99-10499-102 | T | G | A | 6269 | 10200 |
| 2336 | 99-10502-160 | T | C | A | 6270 | 10201 |
| 2337 | 99-10506-307 | A | C | S | 6271 | 10202 |
| 2338 | 99-10507-216 | C | T | A | 6272 | 10203 |
| 2339 | 99-10509-122 | T | G | A | 6273 | 10204 |
| 2340 | 99-1051-284 | G | A | A | 6274 | 10205 |
| 2341 | 99-10513-347 | T | C | A | 6275 | 10206 |
| 2342 | 99-10514-546 | G | T | A | 6276 | 10207 |
| 2343 | 99-10521-296 | C | T | A | 6277 | 10208 |
| 2344 | 99-10522-395 | A | C | A | 6278 | 10209 |
| 2345 | 99-10536-90 | C | A | S | 6279 | 10210 |
| 2346 | 99-10539-208 | G | A | S | 6280 | 10211 |
| 2347 | 99-10542-326 | C | T | A | 6281 | 10212 |
| 2348 | 99-10543-278 | A | T | S | 6282 | 10213 |
| 2349 | 99-1055-140 | C | T | S | 6283 | 10214 |
| 2350 | 99-10557-276 | T | C | A | 6284 | 10215 |
| 2351 | 99-10567-233 | A | G | S | 6285 | 10216 |
| 2352 | 99-10570-107 | G | A | S | 6286 | 10217 |
| 2353 | 99-10573-375 | G | A | S | 6287 | 10218 |
| 2354 | 99-10575-416 | T | C | A | 6288 | 10219 |
| 2355 | 99-10576-351 | A | G | S | 6289 | 10220 |
| 2356 | 99-10577-36 | T | C | A | 6290 | 10221 |
| 2357 | 99-10581-354 | G | C | S | 6291 | 10222 |
| 2358 | 99-10589-360 | A | C | S | 6292 | 10223 |
| 2359 | 99-10601-463 | C | G | S | 6293 | 10224 |
| 2360 | 99-10606-92 | G | A | S | 6294 | 10225 |
| 2361 | 99-10608-353 | C | T | A | 6295 | 10226 |
| 2362 | 99-10613-277 | C | G | S | 6296 | 10227 |
| 2363 | 99-10618-404 | A | T | S | 6297 | 10228 |
| 2364 | 99-10626-196 | G | C | S | 6298 | 10229 |
| 2365 | 99-10630-236 | G | A | S | 6299 | 10230 |
| 2366 | 99-10632-55 | A | T | S | 6300 | 10231 |
| 2367 | 99-10634-141 | G | A | S | 6301 | 10232 |
| 2368 | 99-10643-161 | T | C | A | 6302 | 10233 |
| 2369 | 99-10659-208 | C | T | A | 6303 | 10234 |
| 2370 | 99-10661-153 | G | A | S | 6304 | 10235 |
| 2371 | 99-10662-397 | C | T | A | 6305 | 10236 |

TABLE 1-continued

| SEQ ID No. | Marker Name | Allele 1ST | Allele 2ND | Preferred microseq. primer | Amplification primer Upstream (PU) | Amplification primer Downstream (RP) |
|---|---|---|---|---|---|---|
| 2372 | 99-10667-251 | G | C | S | 6306 | 10237 |
| 2373 | 99-10675-109 | A | G | S | 6307 | 10238 |
| 2374 | 99-1068-309 | C | T | S | 6308 | 10239 |
| 2375 | 99-10683-117 | A | G | S | 6309 | 10240 |
| 2376 | 99-10689-419 | A | G | S | 6310 | 10241 |
| 2377 | 99-10692-377 | G | A | S | 6311 | 10242 |
| 2378 | 99-10694-446 | C | T | A | 6312 | 10243 |
| 2379 | 99-10695-161 | C | T | A | 6313 | 10244 |
| 2380 | 99-1070-342 | C | T | S | 6314 | 10245 |
| 2381 | 99-10702-261 | G | A | S | 6315 | 10246 |
| 2382 | 99-10706-228 | T | C | A | 6316 | 10247 |
| 2383 | 99-10708-28 | G | A | S | 6317 | 10248 |
| 2384 | 99-10709-460 | G | A | S | 6318 | 10249 |
| 2385 | 99-10715-43 | A | G | S | 6319 | 10250 |
| 2386 | 99-10719-455 | C | T | S | 6320 | 10251 |
| 2387 | 99-10720-63 | A | G | S | 6321 | 10252 |
| 2388 | 99-10731-195 | C | T | S | 6322 | 10253 |
| 2389 | 99-10735-238 | T | C | A | 6323 | 10254 |
| 2390 | 99-1074-127 | G | A | A | 6324 | 10255 |
| 2391 | 99-10741-421 | A | C | S | 6325 | 10256 |
| 2392 | 99-10743-315 | T | A | S | 6326 | 10257 |
| 2393 | 99-1075-314 | G | A | A | 6327 | 10258 |
| 2394 | 99-10752-366 | A | G | S | 6328 | 10259 |
| 2395 | 99-1076-116 | C | T | A | 6329 | 10260 |
| 2396 | 99-10769-291 | A | C | S | 6330 | 10261 |
| 2397 | 99-10771-266 | A | C | S | 6331 | 10262 |
| 2398 | 99-10775-331 | A | G | S | 6332 | 10263 |
| 2399 | 99-10776-447 | T | A | S | 6333 | 10264 |
| 2400 | 99-1079-237 | C | G | S | 6334 | 10265 |
| 2401 | 99-1081-159 | A | T | S | 6335 | 10266 |
| 2402 | 99-10816-272 | G | A | S | 6336 | 10267 |
| 2403 | 99-1082-180 | T | A | S | 6337 | 10268 |
| 2404 | 99-10839-239 | C | T | A | 6338 | 10269 |
| 2405 | 99-10842-232 | A | G | S | 6339 | 10270 |
| 2406 | 99-10843-114 | A | G | S | 6340 | 10271 |
| 2407 | 99-10856-246 | C | G | S | 6341 | 10272 |
| 2408 | 99-10861-96 | T | C | A | 6342 | 10273 |
| 2409 | 99-10862-397 | T | C | A | 6343 | 10274 |
| 2410 | 99-10864-418 | C | G | S | 6344 | 10275 |
| 2411 | 99-10870-234 | G | A | S | 6345 | 10276 |
| 2412 | 99-10874-69 | G | A | S | 6346 | 10277 |
| 2413 | 99-10879-386 | A | G | S | 6347 | 10278 |
| 2414 | 99-10887-214 | A | G | S | 6348 | 10279 |
| 2415 | 99-10890-201 | T | G | A | 6349 | 10280 |
| 2416 | 99-10894-35 | T | C | A | 6350 | 10281 |
| 2417 | 99-10898-209 | G | T | A | 6351 | 10282 |
| 2418 | 99-10904-111 | C | T | A | 6352 | 10283 |
| 2419 | 99-10905-85 | C | T | A | 6353 | 10284 |
| 2420 | 99-1091-446 | C | T | S | 6354 | 10285 |
| 2421 | 99-10927-388 | G | C | S | 6355 | 10286 |
| 2422 | 99-10929-298 | T | A | S | 6356 | 10287 |
| 2423 | 99-10930-95 | A | T | S | 6357 | 10288 |
| 2424 | 99-10937-64 | T | C | A | 6358 | 10289 |
| 2425 | 99-10944-83 | G | A | S | 6359 | 10290 |
| 2426 | 99-10951-434 | T | C | A | 6360 | 10291 |
| 2427 | 99-10959-113 | C | T | A | 6361 | 10292 |
| 2428 | 99-10964-89 | T | C | A | 6362 | 10293 |
| 2429 | 99-10965-174 | C | A | S | 6363 | 10294 |
| 2430 | 99-10966-113 | G | A | S | 6364 | 10295 |
| 2431 | 99-10974-193 | T | A | S | 6365 | 10296 |
| 2432 | 99-10978-393 | T | A | S | 6366 | 10297 |
| 2433 | 99-10979-156 | T | A | S | 6367 | 10298 |
| 2434 | 99-10988-242 | T | A | S | 6368 | 10299 |
| 2435 | 99-10992-98 | G | A | S | 6369 | 10300 |
| 2436 | 99-11000-163 | A | G | S | 6370 | 10301 |
| 2437 | 99-11001-393 | C | T | A | 6371 | 10302 |
| 2438 | 99-11003-361 | G | A | S | 6372 | 10303 |
| 2439 | 99-11006-426 | C | T | A | 6373 | 10304 |
| 2440 | 99-11007-68 | T | C | A | 6374 | 10305 |
| 2441 | 99-11014-194 | C | A | S | 6375 | 10306 |
| 2442 | 99-11034-317 | C | T | A | 6376 | 10307 |
| 2443 | 99-11035-299 | C | T | A | 6377 | 10308 |
| 2444 | 99-11037-218 | C | A | S | 6378 | 10309 |
| 2445 | 99-1105-127 | A | C | S | 6379 | 10310 |
| 2446 | 99-1J051-154 | A | T | S | 6380 | 10311 |
| 2447 | 99-11063-111 | G | C | S | 6381 | 10312 |
| 2448 | 99-11074-187 | A | G | S | 6382 | 10313 |
| 2449 | 99-11075-311 | G | A | S | 6383 | 10314 |
| 2450 | 99-11089-424 | C | A | S | 6384 | 10315 |
| 2451 | 99-11094-427 | G | A | A | 6385 | 10316 |
| 2452 | 99-11099-179 | A | G | S | 6386 | 10317 |
| 2453 | 99-11103-88 | A | T | S | 6387 | 10318 |
| 2454 | 99-11106-117 | C | T | A | 6388 | 10319 |
| 2455 | 99-11110-375 | C | T | A | 6389 | 10320 |
| 2456 | 99-11115-133 | A | G | S | 6390 | 10321 |
| 2457 | 99-11119-132 | T | C | A | 6391 | 10322 |
| 2458 | 99-11128-162 | A | G | 8 | 6392 | 10323 |
| 2459 | 99-11136-374 | G | A | S | 6393 | 10324 |
| 2460 | 99-11142-139 | T | C | A | 6394 | 10325 |
| 2461 | 99-11143-443 | A | C | S | 6395 | 10326 |
| 2462 | 99-11144-137 | G | A | S | 6396 | 10327 |
| 2463 | 99-11148-369 | A | C | S | 6397 | 10328 |
| 2464 | 99-11158-255 | C | T | A | 6398 | 10329 |
| 2465 | 99-11163-293 | C | G | S | 6399 | 10330 |
| 2466 | 99-11164-298 | C | T | A | 6400 | 10331 |
| 2467 | 99-11168-197 | G | A | S | 6401 | 10332 |
| 2468 | 99-11175-348 | A | C | S | 6402 | 10333 |
| 2469 | 99-11179-239 | C | T | A | 6403 | 10334 |
| 2470 | 99-11180-148 | A | G | S | 6404 | 10335 |
| 2471 | 99-11183-166 | G | A | S | 6405 | 10336 |
| 2472 | 99-11191-86 | A | G | S | 6406 | 10337 |
| 2473 | 99-11210-235 | G | A | S | 6407 | 10338 |
| 2474 | 99-11214-188 | T | G | A | 6408 | 10339 |
| 2475 | 99-11218-174 | G | A | S | 6409 | 10340 |
| 2476 | 99-11236-63 | C | T | A | 6410 | 10341 |
| 2477 | 99-11247-86 | C | G | S | 6411 | 10342 |
| 2478 | 99-11248-404 | A | G | S | 6412 | 10343 |
| 2479 | 99-11252-263 | T | A | S | 6413 | 10344 |
| 2480 | 99-11255-375 | G | A | S | 6414 | 10345 |
| 2481 | 99-11260-422 | C | T | A | 6415 | 10346 |
| 2482 | 99-11261-255 | G | A | S | 6416 | 10347 |
| 2483 | 99-11293-125 | G | A | S | 6417 | 10348 |
| 2484 | 99-11313-95 | G | A | S | 6418 | 10349 |
| 2485 | 99-11320-29 | C | T | A | 6419 | 10350 |
| 2486 | 99-11326-356 | A | G | S | 6420 | 10351 |
| 2487 | 99-11340-89 | C | T | A | 6421 | 10352 |
| 2488 | 99-11346-222 | T | C | A | 6422 | 10353 |
| 2489 | 99-11350-116 | A | G | S | 6423 | 10354 |
| 2490 | 99-11356-187 | A | T | S | 6424 | 10355 |
| 2491 | 99-11362-334 | C | T | A | 6425 | 10356 |
| 2492 | 99-11369-112 | C | G | S | 6426 | 10357 |
| 2493 | 99-11372-162 | C | A | 8 | 6427 | 10358 |
| 2494 | 99-11377-384 | A | G | S | 6428 | 10359 |
| 2495 | 99-11381-256 | C | G | S | 6429 | 10360 |
| 2496 | 99-11385-245 | C | T | A | 6430 | 10361 |
| 2497 | 99-11413-239 | A | G | S | 6431 | 10362 |
| 2498 | 99-1143-340 | G | A | S | 6432 | 10363 |
| 2499 | 99-11430-162 | C | A | S | 6433 | 10364 |
| 2500 | 99-11431-333 | A | G | S | 6434 | 10365 |
| 2501 | 99-11449-297 | A | G | S | 6435 | 10366 |
| 2502 | 99-11464-236 | C | G | S | 6436 | 10367 |
| 2503 | 99-11466-107 | T | C | A | 6437 | 10368 |
| 2504 | 99-11485-396 | T | A | S | 6438 | 10369 |
| 2505 | 99-11492-360 | A | T | S | 6439 | 10370 |
| 2506 | 99-11499-45 | G | A | S | 6440 | 10371 |
| 2507 | 99-11505-92 | A | G | S | 6441 | 10372 |
| 2508 | 99-11506-224 | G | C | S | 6442 | 10373 |
| 2509 | 99-11520-170 | A | G | S | 6443 | 10374 |
| 2510 | 99-11521-146 | G | T | A | 6444 | 10375 |
| 2511 | 99-11522-313 | C | T | A | 6445 | 10376 |
| 2512 | 99-11528-137 | A | T | S | 6446 | 10377 |
| 2513 | 99-11530-388 | G | A | S | 6447 | 10378 |
| 2514 | 99-11533-375 | C | G | S | 6448 | 10379 |
| 2515 | 99-11535-193 | G | T | A | 6449 | 10380 |
| 2516 | 99-11543-415 | A | T | S | 6450 | 10381 |
| 2517 | 99-11545-180 | T | C | A | 6451 | 10382 |

TABLE 1-continued

| SEQ ID No. | Marker Name | Allele 1ST | 2ND | Preferred microseq. primer | Amplification primer Upstream (PU) | Downstream (RP) |
|---|---|---|---|---|---|---|
| 2518 | 99-11555-397 | C | T | A | 6452 | 10383 |
| 2519 | 99-11559-81 | C | A | S | 6453 | 10384 |
| 2520 | 99-11563-183 | A | G | S | 6454 | 10385 |
| 2521 | 99-11565-305 | C | A | S | 6455 | 10386 |
| 2522 | 99-11566-385 | G | A | S | 6456 | 10387 |
| 2523 | 99-11580-97 | A | G | S | 6457 | 10388 |
| 2524 | 99-11584-69 | A | G | 8 | 6458 | 10389 |
| 2525 | 99-11587-202 | A | G | S | 6459 | 10390 |
| 2526 | 99-11592-297 | A | G | S | 6460 | 10391 |
| 2527 | 99-11600-48 | A | G | S | 6461 | 10392 |
| 2528 | 99-11601-441 | C | T | A | 6462 | 10393 |
| 2529 | 99-11602-93 | G | A | S | 6463 | 10394 |
| 2530 | 99-11604-396 | T | C | A | 6464 | 10395 |
| 2531 | 99-11611-259 | A | G | S | 6465 | 10396 |
| 2532 | 99-11613-315 | T | C | A | 6466 | 10397 |
| 2533 | 99-11620-149 | A | C | S | 6467 | 10398 |
| 2534 | 99-11635-363 | C | T | A | 6468 | 10399 |
| 2535 | 99-11643-378 | C | T | A | 6469 | 10400 |
| 2536 | 99-11645-157 | C | T | A | 6470 | 10401 |
| 2537 | 99-11658-275 | G | A | S | 6471 | 10402 |
| 2538 | 99-11668-308 | T | C | A | 6472 | 10403 |
| 2539 | 99-11669-394 | C | T | A | 6473 | 10404 |
| 2540 | 99-11670-486 | G | T | A | 6474 | 10405 |
| 2541 | 99-11685-200 | T | C | A | 6475 | 10406 |
| 2542 | 99-11697-345 | C | T | A | 6476 | 10407 |
| 2543 | 99-11700-326 | T | C | A | 6477 | 10408 |
| 2544 | 99-11704-23 | T | C | A | 6478 | 10409 |
| 2545 | 99-11705-302 | G | T | A | 6479 | 10410 |
| 2546 | 99-11723-211 | A | T | S | 6480 | 10411 |
| 2547 | 99-11743-233 | C | T | A | 6481 | 10412 |
| 2548 | 99-11745-256 | A | G | S | 6482 | 10413 |
| 2549 | 99-11746-238 | A | G | S | 6483 | 10414 |
| 2550 | 99-11780-292 | G | T | A | 6484 | 10415 |
| 2551 | 99-11785-167 | A | G | S | 6485 | 10416 |
| 2552 | 99-11786-98 | G | T | A | 6486 | 10417 |
| 2553 | 99-11787-281 | G | A | S | 6487 | 10418 |
| 2554 | 99-11788-69 | G | A | S | 6488 | 10419 |
| 2555 | 99-11789-348 | A | C | S | 6489 | 10420 |
| 2556 | 99-11797-147 | A | G | S | 6490 | 10421 |
| 2557 | 99-11810-289 | A | C | S | 6491 | 10422 |
| 2558 | 99-11811-158 | A | G | S | 6492 | 10423 |
| 2559 | 99-1182-310 | G | A | A | 6493 | 10424 |
| 2560 | 99-11823-118 | G | A | S | 6494 | 10425 |
| 2561 | 99-11824-90 | T | A | S | 6495 | 10426 |
| 2562 | 99-1183-182 | G | A | A | 6496 | 10427 |
| 2563 | 99-11830-334 | C | G | S | 6497 | 10428 |
| 2564 | 99-11831-321 | C | T | A | 6498 | 10429 |
| 2565 | 99-11839-223 | C | T | A | 6499 | 10430 |
| 2566 | 99-11842-197 | T | C | A | 6500 | 10431 |
| 2567 | 99-1185-317 | T | G | A | 6501 | 10432 |
| 2568 | 99-11851-45 | C | G | S | 6502 | 10433 |
| 2569 | 99-11857-368 | G | A | S | 6503 | 10434 |
| 2570 | 99-1186-249 | G | A | A | 6504 | 10435 |
| 2571 | 99-11861-254 | C | T | A | 6505 | 10436 |
| 2572 | 99-11877-237 | T | C | A | 6506 | 10437 |
| 2573 | 99-11880-90 | G | C | S | 6507 | 10438 |
| 2574 | 99-11882-120 | A | G | S | 6508 | 10439 |
| 2575 | 99-11894-470 | G | A | S | 6509 | 10440 |
| 2576 | 99-11917-129 | A | G | S | 6510 | 10441 |
| 2577 | 99-11922-206 | G | A | S | 6511 | 10442 |
| 2578 | 99-11930-395 | C | T | A | 6512 | 10443 |
| 2579 | 99-11966-288 | A | G | S | 6513 | 10444 |
| 2580 | 99-11989-233 | C | A | S | 6514 | 10445 |
| 2581 | 99-11993-468 | C | T | A | 6515 | 10446 |
| 2582 | 99-12000-355 | T | C | A | 6516 | 10447 |
| 2583 | 99-12005-282 | C | T | A | 6517 | 10448 |
| 2584 | 99-12017-203 | G | T | A | 6518 | 10449 |
| 2585 | 99-1202-340 | C | T | S | 6519 | 10450 |
| 2586 | 99-12028-121 | T | C | A | 6520 | 10451 |
| 2587 | 99-1203-272 | A | G | A | 6521 | 10452 |
| 2588 | 99-12038-420 | C | T | A | 6522 | 10453 |
| 2589 | 99-12039-389 | C | T | A | 6523 | 10454 |
| 2590 | 99-12048-300 | A | G | S | 6524 | 10455 |
| 2591 | 99-12049-245 | A | G | S | 6525 | 10456 |
| 2592 | 99-12050-459 | A | G | S | 6526 | 10457 |
| 2593 | 99-12061-211 | A | G | S | 6527 | 10458 |
| 2594 | 99-12062-94 | G | A | S | 6528 | 10459 |
| 2595 | 99-12068-348 | T | C | A | 6529 | 10460 |
| 2596 | 99-12087-45 | C | T | A | 6530 | 10461 |
| 2597 | 99-1211-59 | C | T | A | 6531 | 10462 |
| 2598 | 99-12130-72 | G | A | S | 6532 | 10463 |
| 2599 | 99-12133-294 | T | C | A | 6533 | 10464 |
| 2600 | 99-12135-288 | C | A | S | 6534 | 10465 |
| 2601 | 99-12152-332 | A | G | S | 6535 | 10466 |
| 2602 | 99-12158-148 | A | G | S | 6536 | 10467 |
| 2603 | 99-12168-256 | C | T | A | 6537 | 10468 |
| 2604 | 99-12171-93 | G | A | S | 6538 | 10469 |
| 2605 | 99-12178-423 | C | T | A | 6539 | 10470 |
| 2606 | 99-12181-226 | T | C | A | 6540 | 10471 |
| 2607 | 99-12186-229 | C | T | A | 6541 | 10472 |
| 2608 | 99-12198-289 | A | G | S | 6542 | 10473 |
| 2609 | 99-12199-246 | T | C | A | 6543 | 10474 |
| 2610 | 99-12203-356 | C | G | S | 6544 | 10475 |
| 2611 | 99-12224-368 | A | G | S | 6545 | 10476 |
| 2612 | 99-12228-184 | C | T | A | 6546 | 10477 |
| 2613 | 99-12241-380 | T | G | A | 6547 | 10478 |
| 2614 | 99-12253-145 | T | C | A | 6548 | 10479 |
| 2615 | 99-12265-324 | A | T | S | 6549 | 10480 |
| 2616 | 99-12267-161 | G | T | A | 6550 | 10481 |
| 2617 | 99-12268-54 | G | A | S | 6551 | 10482 |
| 2618 | 99-12270-408 | T | G | A | 6552 | 10483 |
| 2619 | 99-12271-298 | G | A | S | 6553 | 10484 |
| 2620 | 99-12275-214 | A | T | S | 6554 | 10485 |
| 2621 | 99-12299-433 | T | G | A | 6555 | 10486 |
| 2622 | 99-12303-460 | C | T | A | 6556 | 10487 |
| 2623 | 99-12335-394 | C | T | A | 6557 | 10488 |
| 2624 | 99-12338-83 | T | C | A | 6558 | 10489 |
| 2625 | 99-12344-171 | G | C | S | 6559 | 10490 |
| 2626 | 99-12347-490 | G | C | S | 6560 | 10491 |
| 2627 | 99-12348-74 | T | G | A | 6561 | 10492 |
| 2628 | 99-12352-124 | T | G | A | 6562 | 10493 |
| 2629 | 99-12356-272 | T | C | A | 6563 | 10494 |
| 2630 | 99-12361-88 | T | C | A | 6564 | 10495 |
| 2631 | 99-12368-335 | A | C | S | 6565 | 10496 |
| 2632 | 99-12370-67 | G | A | S | 6566 | 10497 |
| 2633 | 99-12384-135 | G | A | S | 6567 | 10498 |
| 2634 | 99-12388-466 | G | A | S | 6568 | 10499 |
| 2635 | 99-12393-326 | A | G | S | 6569 | 10500 |
| 2636 | 99-12399-180 | C | T | A | 6570 | 10501 |
| 2637 | 99-12412-381 | T | C | A | 6571 | 10502 |
| 2638 | 99-12415-509 | A | G | S | 6572 | 10503 |
| 2639 | 99-12444-400 | A | G | S | 6573 | 10504 |
| 2640 | 99-12465-227 | G | A | A | 6574 | 10505 |
| 2641 | 99-12468-236 | G | T | A | 6575 | 10506 |
| 2642 | 99-12470-288 | G | A | A | 6576 | 10507 |
| 2643 | 99-12522-196 | T | C | S | 6577 | 10508 |
| 2644 | 99-12561-278 | C | G | S | 6578 | 10509 |
| 2645 | 99-12570-265 | G | A | A | 6579 | 10510 |
| 2646 | 99-12595-313 | C | T | S | 6580 | 10511 |
| 2647 | 99-12596-334 | T | C | S | 6581 | 10512 |
| 2648 | 99-12598-191 | C | A | S | 6582 | 10513 |
| 2649 | 99-12602-212 | G | T | A | 6583 | 10514 |
| 2650 | 99-12605-365 | C | T | S | 6584 | 10515 |
| 2651 | 99-12607-384 | A | G | A | 6585 | 10516 |
| 2652 | 99-12664-222 | C | A | S | 6586 | 10517 |
| 2653 | 99-12696-116 | T | C | 8 | 6587 | 10518 |
| 2654 | 99-12960-443 | G | A | S | 6588 | 10519 |
| 2655 | 99-12965-451 | C | T | A | 6589 | 10520 |
| 2656 | 99-12969-128 | C | T | A | 6590 | 10521 |
| 2657 | 99-12970-339 | A | G | S | 6591 | 10522 |
| 2658 | 99-12973-162 | G | A | S | 6592 | 10523 |
| 2659 | 99-13074-132 | T | C | A | 6593 | 10524 |
| 2660 | 99-13077-340 | C | T | A | 6594 | 10525 |
| 2661 | 99-1311-59 | C | G | S | 6595 | 10526 |
| 2662 | 99-13113-234 | G | A | S | 6596 | 10527 |
| 2663 | 99-13205-67 | T | A | S | 6597 | 10528 |

TABLE 1-continued

| SEQ ID No. | Marker Name | Allele 1ST | 2ND | Preferred microseq. primer | Amplification primer Upstream (PU) | Downstream (RP) |
|---|---|---|---|---|---|---|
| 2664 | 99-1326-203 | C | T | A | 6598 | 10529 |
| 2665 | 99-1333-123 | C | G | S | 6599 | 10530 |
| 2666 | 99-1335-195 | A | G | A | 6600 | 10531 |
| 2667 | 99-13350-376 | T | G | A | 6601 | 10532 |
| 2668 | 99-13376-288 | A | T | S | 6602 | 10533 |
| 2669 | 99-13473-135 | C | T | A | 6603 | 10534 |
| 2670 | 99-13530-325 | T | C | S | 6604 | 10535 |
| 2671 | 99-13563-83 | C | T | S | 6605 | 10536 |
| 2672 | 99-13579-242 | G | C | S | 6606 | 10537 |
| 2673 | 99-13609-327 | T | C | A | 6607 | 10538 |
| 2674 | 99-13621-358 | T | C | S | 6608 | 10539 |
| 2675 | 99-1370-401 | A | G | S | 6609 | 10540 |
| 2676 | 99-13864-64 | G | T | A | 6610 | 10541 |
| 2677 | 99-13938-286 | T | C | A | 6611 | 10542 |
| 2678 | 99-13943-247 | T | C | A | 6612 | 10543 |
| 2679 | 99-13948-182 | T | A | S | 6613 | 10544 |
| 2680 | 99-13966-334 | T | C | A | 6614 | 10545 |
| 2681 | 99-14002-395 | C | G | S | 6615 | 10546 |
| 2682 | 99-14022-347 | C | T | A | 6616 | 10547 |
| 2683 | 99-14042-464 | G | A | S | 6617 | 10548 |
| 2684 | 99-14045-353 | T | C | A | 6618 | 10549 |
| 2685 | 99-14074-326 | C | T | A | 6619 | 10550 |
| 2686 | 99-14093-333 | T | C | A | 6620 | 10551 |
| 2687 | 99-14105-357 | G | C | S | 6621 | 10552 |
| 2688 | 99-14107-175 | A | G | S | 6622 | 10553 |
| 2689 | 99-14111-346 | C | G | S | 6623 | 10554 |
| 2690 | 99-14177-226 | A | G | S | 6624 | 10555 |
| 2691 | 99-14198-374 | T | G | A | 6625 | 10556 |
| 2692 | 99-14225-345 | T | C | A | 6626 | 10557 |
| 2693 | 99-14228-387 | C | G | S | 6627 | 10558 |
| 2694 | 99-14410-373 | T | C | A | 6628 | 10559 |
| 2695 | 99-14413-383 | T | G | A | 6629 | 10560 |
| 2696 | 99-14415-106 | C | T | A | 6630 | 10561 |
| 2697 | 99-14424-353 | G | A | S | 6631 | 10562 |
| 2698 | 99-14473-243 | A | C | S | 6632 | 10563 |
| 2699 | 99-14476-377 | T | G | A | 6633 | 10564 |
| 2700 | 99-14481-386 | T | C | A | 6634 | 10565 |
| 2701 | 99-14489-415 | G | T | A | 6635 | 10566 |
| 2702 | 99-14673-334 | A | G | S | 6636 | 10567 |
| 2703 | 99-14705-290 | A | G | S | 6637 | 10568 |
| 2704 | 99-14739-205 | C | G | S | 6638 | 10569 |
| 2705 | 99-14743-418 | C | T | A | 6639 | 10570 |
| 2706 | 99-14944-119 | A | C | S | 6640 | 10571 |
| 2707 | 99-14949-472 | G | A | S | 6641 | 10572 |
| 2708 | 99-15000-259 | C | T | A | 6642 | 10573 |
| 2709 | 99-15067-278 | T | C | A | 6643 | 10574 |
| 2710 | 99-15192-224 | C | T | A | 6644 | 10575 |
| 2711 | 99-15369-90 | C | T | A | 6645 | 10576 |
| 2712 | 99-15423-223 | G | A | S | 6646 | 10577 |
| 2713 | 99-15471-316 | G | T | A | 6647 | 10578 |
| 2714 | 99-15538-250 | T | C | A | 6648 | 10579 |
| 2715 | 99-15588-430 | A | G | S | 6649 | 10580 |
| 2716 | 99-15615-368 | G | A | A | 6650 | 10581 |
| 2717 | 99-15653-359 | G | A | S | 6651 | 10582 |
| 2718 | 99-15654-122 | G | A | S | 6652 | 10583 |
| 2719 | 99-15724-147 | C | T | A | 6653 | 10584 |
| 2720 | 99-15784-28 | G | T | A | 6654 | 10585 |
| 2721 | 99-1591-235 | G | A | A | 6655 | 10586 |
| 2722 | 99-15963-394 | A | G | S | 6656 | 10587 |
| 2723 | 99-15984-100 | A | G | S | 6657 | 10588 |
| 2724 | 99-16017-426 | C | T | A | 6658 | 10589 |
| 2725 | 99-16026-359 | G | A | S | 6659 | 10590 |
| 2726 | 99-1624-377 | G | A | A | 6660 | 10591 |
| 2727 | 99-16241-126 | T | G | A | 6661 | 10592 |
| 2728 | 99-16259-304 | A | C | S | 6662 | 10593 |
| 2729 | 99-16284-389 | T | C | A | 6663 | 10594 |
| 2730 | 99-16343-30 | T | C | A | 6664 | 10595 |
| 2731 | 99-16401-88 | C | T | A | 6665 | 10596 |
| 2732 | 99-16406-349 | C | T | A | 6666 | 10597 |
| 2733 | 99-16422-240 | A | G | S | 6667 | 10598 |
| 2734 | 99-16428-275 | C | T | A | 6668 | 10599 |
| 2735 | 99-16430-358 | T | G | A | 6669 | 10600 |
| 2736 | 99-16432-114 | T | A | S | 6670 | 10601 |
| 2737 | 99-16647-382 | T | C | A | 6671 | 10602 |
| 2738 | 99-16661-147 | G | A | S | 6672 | 10603 |
| 2739 | 99-16686-82 | A | C | S | 6673 | 10604 |
| 2740 | 99-16714-82 | G | A | A | 6674 | 10605 |
| 2741 | 99-16735-210 | A | G | A | 6675 | 10606 |
| 2742 | 99-16739-245 | G | A | A | 6676 | 10607 |
| 2743 | 99-16751-318 | A | T | S | 6677 | 10608 |
| 2744 | 99-16752-78 | C | G | S | 6678 | 10609 |
| 2745 | 99-16754-63 | A | G | A | 6679 | 10610 |
| 2746 | 99-16758-60 | G | T | A | 6680 | 10611 |
| 2747 | 99-16761-370 | A | G | A | 6681 | 10612 |
| 2748 | 99-16769-459 | G | A | A | 6682 | 10613 |
| 2749 | 99-16771-222 | C | A | S | 6683 | 10614 |
| 2750 | 99-16772-36 | T | C | S | 6684 | 10615 |
| 2751 | 99-16774-183 | G | T | A | 6685 | 10616 |
| 2752 | 99-16776-275 | C | G | S | 6686 | 10617 |
| 2753 | 99-16794-291 | A | T | S | 6687 | 10618 |
| 2754 | 99-16797-385 | G | A | A | 6688 | 10619 |
| 2755 | 99-16815-282 | G | A | A | 6689 | 10620 |
| 2756 | 99-16835-413 | G | A | A | 6690 | 10621 |
| 2757 | 99-16909-151 | T | C | A | 6691 | 10622 |
| 2758 | 99-17024-215 | C | T | S | 6692 | 10623 |
| 2759 | 99-17046-162 | A | C | S | 6693 | 10624 |
| 2760 | 99-17075-173 | C | T | A | 6694 | 10625 |
| 2761 | 99-17107-271 | G | T | A | 6695 | 10626 |
| 2762 | 99-17162-81 | G | T | A | 6696 | 10627 |
| 2763 | 99-17167-55 | A | G | S | 6697 | 10628 |
| 2764 | 99-17214-451 | T | C | A | 6698 | 10629 |
| 2765 | 99-17254-339 | G | A | A | 6699 | 10630 |
| 2766 | 99-17402-339 | G | A | S | 6700 | 10631 |
| 2767 | 99-17492-271 | T | C | A | 6701 | 10632 |
| 2768 | 99-17519-116 | G | A | S | 6702 | 10633 |
| 2769 | 99-17581-374 | G | A | A | 6703 | 10634 |
| 2770 | 99-17716-400 | C | T | S | 6704 | 10635 |
| 2771 | 99-18122-403 | C | T | A | 6705 | 10636 |
| 2772 | 99-18126-160 | A | T | S | 6706 | 10637 |
| 2773 | 99-18127-283 | A | G | S | 6707 | 10638 |
| 2774 | 99-18141-152 | T | C | A | 6708 | 10639 |
| 2775 | 99-18190-317 | G | A | S | 6709 | 10640 |
| 2776 | 99-18321-371 | T | C | S | 6710 | 10641 |
| 2777 | 99-1833-56 | T | C | S | 6711 | 10642 |
| 2778 | 99-18334-485 | A | G | A | 6712 | 10643 |
| 2779 | 99-18396-324 | A | C | S | 6713 | 10644 |
| 2780 | 99-18471-410 | A | G | A | 6714 | 10645 |
| 2781 | 99-18528-195 | G | A | A | 6715 | 10646 |
| 2782 | 99-18576-182 | A | C | S | 6716 | 10647 |
| 2783 | 99-18581-34 | T | C | S | 6717 | 10648 |
| 2784 | 99-18645-309 | G | A | S | 6718 | 10649 |
| 2785 | 99-18696-213 | T | C | S | 6719 | 10650 |
| 2786 | 99-18698-346 | C | G | S | 6720 | 10651 |
| 2787 | 99-18710-208 | C | T | S | 6721 | 10652 |
| 2788 | 99-18717-319 | T | A | S | 6722 | 10653 |
| 2789 | 99-18718-362 | C | G | S | 6723 | 10654 |
| 2790 | 99-18771-300 | C | T | S | 6724 | 10655 |
| 2791 | 99-1879-393 | G | A | A | 6725 | 10656 |
| 2792 | 99-18886-50 | T | A | S | 6726 | 10657 |
| 2793 | 99-18944-242 | C | T | S | 6727 | 10658 |
| 2794 | 99-19023-347 | T | C | S | 6728 | 10659 |
| 2795 | 99-19027-222 | A | G | A | 6729 | 10660 |
| 2796 | 99-19033-208 | G | T | A | 6730 | 10661 |
| 2797 | 99-19040-395 | A | G | A | 6731 | 10662 |
| 2798 | 99-19041-87 | A | G | A | 6732 | 10663 |
| 2799 | 99-19048-487 | C | T | S | 6733 | 10664 |
| 2800 | 99-19050-251 | T | C | S | 6734 | 10665 |
| 2801 | 99-19053-241 | T | A | S | 6735 | 10666 |
| 2802 | 99-19055-264 | T | C | A | 6736 | 10667 |
| 2803 | 99-19059-347 | C | A | A | 6737 | 10668 |
| 2804 | 99-19069-44 | C | T | A | 6738 | 10669 |
| 2805 | 99-19095-106 | T | C | S | 6739 | 10670 |
| 2806 | 99-19096-317 | A | G | A | 6740 | 10671 |
| 2807 | 99-19104-66 | T | C | S | 6741 | 10672 |
| 2808 | 99-19105-114 | A | G | A | 6742 | 10673 |
| 2809 | 99-19108-156 | C | T | S | 6743 | 10674 |

TABLE 1-continued

| SEQ ID No. | Marker Name | Allele 1ST | Allele 2ND | Preferred microseq. primer | Amplification primer Upstream (PU) | Amplification primer Downstream (RP) |
|---|---|---|---|---|---|---|
| 2810 | 99-19110-175 | A | G | A | 6744 | 10675 |
| 2811 | 99-19122-58 | A | G | A | 6745 | 10676 |
| 2812 | 99-19123-242 | A | G | A | 6746 | 10677 |
| 2813 | 99-19130-86 | T | C | S | 6747 | 10678 |
| 2814 | 99-19137-156 | C | T | S | 6748 | 10679 |
| 2815 | 99-19142-245 | T | C | S | 6749 | 10680 |
| 2816 | 99-19154-146 | C | T | S | 6750 | 10681 |
| 2817 | 99-19155-75 | A | G | A | 6751 | 10682 |
| 2818 | 99-19167-269 | A | G | A | 6752 | 10683 |
| 2819 | 99-19170-193 | A | G | A | 6753 | 10684 |
| 2820 | 99-19171-120 | G | A | S | 6754 | 10685 |
| 2821 | 99-19175-150 | G | A | A | 6755 | 10686 |
| 2822 | 99-19177-425 | C | T | S | 6756 | 10687 |
| 2823 | 99-19178-163 | T | C | S | 6757 | 10688 |
| 2824 | 99-19210-502 | A | G | A | 6758 | 10689 |
| 2825 | 99-19219-316 | G | A | A | 6759 | 10690 |
| 2826 | 99-19220-220 | T | C | S | 6760 | 10691 |
| 2827 | 99-19223-238 | C | T | S | 6761 | 10692 |
| 2828 | 99-19226-169 | A | G | A | 6762 | 10693 |
| 2829 | 99-19228-319 | G | A | A | 6763 | 10694 |
| 2830 | 99-19236-409 | G | A | A | 6764 | 10695 |
| 2831 | 99-19241-362 | C | T | S | 6765 | 10696 |
| 2832 | 99-19242-254 | G | A | A | 6766 | 10697 |
| 2833 | 99-19283-172 | A | G | A | 6767 | 10698 |
| 2834 | 99-19295-95 | C | j | S | 6768 | 10699 |
| 2835 | 99-19304-270 | T | C | S | 6769 | 10700 |
| 2836 | 99-19305-367 | A | C | S | 6770 | 10701 |
| 2837 | 99-19309-296 | T | C | S | 6771 | 10702 |
| 2838 | 99-19312-34 | G | A | A | 6772 | 10703 |
| 2839 | 99-19324-214 | A | G | A | 6773 | 10704 |
| 2840 | 99-19330-274 | G | T | A | 6774 | 10705 |
| 2841 | 99-19347-228 | G | A | A | 6775 | 10706 |
| 2842 | 99-19348-229 | T | C | S | 6776 | 10707 |
| 2843 | 99-19351-360 | A | T | S | 6777 | 10708 |
| 2844 | 99-19368-92 | C | A | S | 6778 | 10709 |
| 2845 | 99-19375-434 | G | A | A | 6779 | 10710 |
| 2846 | 99-19381-249 | G | A | A | 6780 | 10711 |
| 2847 | 99-19383-432 | G | C | S | 6781 | 10712 |
| 2848 | 99-19384-63 | G | A | A | 6782 | 10713 |
| 2849 | 99-19418-61 | G | A | A | 6783 | 10714 |
| 2850 | 99-19420-86 | A | T | S | 6784 | 10715 |
| 2851 | 99-19426-250 | G | A | A | 6785 | 10716 |
| 2852 | 99-19431-249 | A | G | A | 6786 | 10717 |
| 2853 | 99-19438-261 | T | A | S | 6787 | 10718 |
| 2854 | 99-19442-48 | G | A | A | 6788 | 10719 |
| 2855 | 99-19444-350 | T | C | S | 6789 | 10720 |
| 2856 | 99-19450-440 | C | A | S | 6790 | 10721 |
| 2857 | 99-19453-250 | G | T | A | 6791 | 10722 |
| 2858 | 99-19457-182 | T | C | S | 6792 | 10723 |
| 2859 | 99-19460-346 | G | T | A | 6793 | 10724 |
| 2860 | 99-19461-282 | T | C | S | 6794 | 10725 |
| 2861 | 99-19464-165 | A | G | A | 6795 | 10726 |
| 2862 | 99-19466-406 | C | T | S | 6796 | 10727 |
| 2863 | 99-19474-266 | G | T | S | 6797 | 10728 |
| 2864 | 99-19475-113 | G | C | S | 6798 | 10729 |
| 2865 | 99-19477-208 | T | C | S | 6799 | 10730 |
| 2866 | 99-19504-468 | T | C | S | 6800 | 10731 |
| 2867 | 99-19528-278 | C | T | S | 6801 | 10732 |
| 2868 | 99-19529-118 | A | G | A | 6802 | 10733 |
| 2869 | 99-19532-207 | G | T | A | 6803 | 10734 |
| 2870 | 99-19538-272 | A | G | A | 6804 | 10735 |
| 2871 | 99-19544-329 | G | A | A | 6805 | 10736 |
| 2872 | 99-19546-473 | G | A | A | 6806 | 10737 |
| 2873 | 99-19550-397 | G | T | A | 6807 | 10738 |
| 2874 | 99-19553-52 | T | C | S | 6808 | 10739 |
| 2875 | 99-19557-152 | A | G | A | 6809 | 10740 |
| 2876 | 99-19560-289 | G | T | A | 6810 | 10741 |
| 2877 | 99-19562-227 | G | A | A | 6811 | 10742 |
| 2878 | 99-19566-337 | C | G | S | 6812 | 10743 |
| 2879 | 99-19568-273 | C | T | S | 6813 | 10744 |
| 2880 | 99-19575-299 | A | G | A | 6814 | 10745 |
| 2881 | 99-19578-307 | A | G | A | 6815 | 10746 |
| 2882 | 99-19580-323 | C | T | S | 6816 | 10747 |
| 2883 | 99-19584-352 | C | T | S | 6817 | 10748 |
| 2884 | 99-19588-438 | G | A | A | 6818 | 10749 |
| 2885 | 99-19589-118 | C | T | S | 6819 | 10750 |
| 2886 | 99-19601-95 | T | G | A | 6820 | 10751 |
| 2887 | 99-19624-48 | C | G | S | 6821 | 10752 |
| 2888 | 99-19634-149 | A | G | A | 6822 | 10753 |
| 2889 | 99-19639-225 | A | G | A | 6823 | 10754 |
| 2890 | 99-19645-339 | A | G | A | 6824 | 10755 |
| 2891 | 99-19650-338 | G | C | S | 6825 | 10756 |
| 2892 | 99-19651-133 | A | C | S | 6826 | 10757 |
| 2893 | 99-19664-328 | G | A | A | 6827 | 10758 |
| 2894 | 99-19673-125 | C | G | S | 6828 | 10759 |
| 2895 | 99-19678-269 | G | C | S | 6829 | 10760 |
| 2896 | 99-19685-39 | A | T | S | 6830 | 10761 |
| 2897 | 99-19697-304 | C | T | S | 6831 | 10762 |
| 2898 | 99-19703-75 | C | G | S | 6832 | 10763 |
| 2899 | 99-19705-128 | T | C | S | 6833 | 10764 |
| 2900 | 99-19709-299 | T | G | A | 6834 | 10765 |
| 2901 | 99-19711-169 | G | T | A | 6835 | 10766 |
| 2902 | 99-19722-150 | T | C | S | 6836 | 10767 |
| 2903 | 99-19731-244 | A | G | A | 6837 | 10768 |
| 2904 | 99-19732-385 | T | A | S | 6838 | 10769 |
| 2905 | 99-19736-62 | G | A | A | 6839 | 10770 |
| 2906 | 99-19745-330 | C | T | S | 6840 | 10771 |
| 2907 | 99-19749-158 | G | A | A | 6841 | 10772 |
| 2908 | 99-19752-88 | T | C | S | 6842 | 10773 |
| 2909 | 99-19753-300 | G | A | A | 6843 | 10774 |
| 2910 | 99-19756-85 | T | C | S | 6844 | 10775 |
| 2911 | 99-19764-177 | T | C | S | 6845 | 10776 |
| 2912 | 99-19769-227 | C | T | S | 6846 | 10777 |
| 2913 | 99-19780-179 | A | G | A | 6847 | 10778 |
| 2914 | 99-19785-140 | A | G | A | 6848 | 10779 |
| 2915 | 99-19790-398 | G | A | A | 6849 | 10780 |
| 2916 | 99-19791-103 | G | T | A | 6850 | 10781 |
| 2917 | 99-19795-199 | A | G | A | 6851 | 10782 |
| 2918 | 99-19796-256 | T | G | A | 6852 | 10783 |
| 2919 | 99-19807-396 | C | T | S | 6853 | 10784 |
| 2920 | 99-19813-55 | C | T | S | 6854 | 10785 |
| 2921 | 99-19818-156 | C | T | S | 6855 | 10786 |
| 2922 | 99-19826-285 | G | A | A | 6856 | 10787 |
| 2923 | 99-19839-223 | A | G | A | 6857 | 10788 |
| 2924 | 99-19851-40 | C | G | S | 6858 | 10789 |
| 2925 | 99-19858-91 | C | T | S | 6859 | 10790 |
| 2926 | 99-19860-68 | A | G | A | 6860 | 10791 |
| 2927 | 99-19864-112 | T | C | S | 6861 | 10792 |
| 2928 | 99-19871-422 | T | C | S | 6862 | 10793 |
| 2929 | 99-19872-136 | G | A | A | 6863 | 10794 |
| 2930 | 99-19875-99 | A | G | A | 6864 | 10795 |
| 2931 | 99-19876-394 | A | C | S | 6865 | 10796 |
| 2932 | 99-19890-235 | A | C | S | 6866 | 10797 |
| 2933 | 99-19896-142 | G | T | A | 6867 | 10798 |
| 2934 | 99-19901-383 | C | T | S | 6868 | 10799 |
| 2935 | 99-19906-136 | C | G | S | 6869 | 10800 |
| 2936 | 99-19911-90 | G | C | S | 6870 | 10801 |
| 2937 | 99-19916-380 | T | C | S | 6871 | 10802 |
| 2938 | 99-19922-42 | G | A | A | 6872 | 10803 |
| 2939 | 99-19923-383 | G | A | A | 6873 | 10804 |
| 2940 | 99-19933-251 | A | G | A | 6874 | 10805 |
| 2941 | 99-19937-235 | A | G | A | 6875 | 10806 |
| 2942 | 99-19944-306 | T | A | S | 6876 | 10807 |
| 2943 | 99-19951-313 | A | T | S | 6877 | 10808 |
| 2944 | 99-20038-204 | T | C | S | 6878 | 10809 |
| 2945 | 99-20072-277 | A | T | S | 6879 | 10810 |
| 2946 | 99-20226-32 | T | C | S | 6880 | 10811 |
| 2947 | 99-20228-290 | T | C | S | 6881 | 10812 |
| 2948 | 99-20234-101 | C | G | S | 6882 | 10813 |
| 2949 | 99-20537-433 | G | C | S | 6883 | 10814 |
| 2950 | 99-20733-79 | G | A | A | 6884 | 10815 |
| 2951 | 99-20815-363 | A | T | S | 6885 | 10816 |
| 2952 | 99-20896-383 | A | G | A | 6886 | 10817 |
| 2953 | 99-20958-373 | A | G | A | 6887 | 10818 |
| 2954 | 99-21057-337 | T | C | S | 6888 | 10819 |
| 2955 | 99-21059-118 | T | C | S | 6889 | 10820 |

TABLE 1-continued

| SEQ ID No. | Marker Name | Allele 1ST | Allele 2ND | Preferred microseq. primer | Amplification primer Upstream (PU) | Amplification primer Downstream (RP) |
|---|---|---|---|---|---|---|
| 2956 | 99-21110-304 | C | G | S | 6890 | 10821 |
| 2957 | 99-21123-62 | C | T | S | 6891 | 10822 |
| 2958 | 99-21133-169 | G | A | A | 6892 | 10823 |
| 2959 | 99-21181-413 | A | G | A | 6893 | 10824 |
| 2960 | 99-21192-164 | T | A | S | 6894 | 10825 |
| 2961 | 99-21227-295 | T | C | S | 6895 | 10826 |
| 2962 | 99-21229-81 | G | A | A | 6896 | 10827 |
| 2963 | 99-21240-419 | C | T | S | 6897 | 10828 |
| 2964 | 99-21242-57 | T | A | S | 6898 | 10829 |
| 2965 | 99-21244-495 | G | A | A | 6899 | 10830 |
| 2966 | 99-21252-77 | T | C | S | 6900 | 10831 |
| 2967 | 99-21267-111 | C | T | S | 6901 | 10832 |
| 2968 | 99-21284-322 | G | A | A | 6902 | 10833 |
| 2969 | 99-21293-252 | A | G | A | 6903 | 10834 |
| 2970 | 99-21307-370 | A | G | A | 6904 | 10835 |
| 2971 | 99-21310-416 | A | G | A | 6905 | 10836 |
| 2972 | 99-21312-319 | C | A | S | 6906 | 10837 |
| 2973 | 99-21323-142 | A | G | A | 6907 | 10838 |
| 2974 | 99-21327-94 | A | G | A | 6908 | 10839 |
| 2975 | 99-21328-173 | C | T | S | 6909 | 10840 |
| 2976 | 99-21329-518 | A | G | A | 6910 | 10841 |
| 2977 | 99-21342-350 | T | C | S | 6911 | 10842 |
| 2978 | 99-21346-290 | G | A | A | 6912 | 10843 |
| 2979 | 99-21360-343 | A | G | A | 6913 | 10844 |
| 2980 | 99-21361-97 | G | T | A | 6914 | 10845 |
| 2981 | 99-21377-73 | C | T | S | 6915 | 10846 |
| 2982 | 99-21378-303 | T | C | S | 6916 | 10847 |
| 2983 | 99-21391-418 | G | A | A | 6917 | 10848 |
| 2984 | 99-21401-117 | T | C | S | 6918 | 10849 |
| 2985 | 99-21423-302 | T | C | S | 6919 | 10850 |
| 2986 | 99-21433-238 | T | G | A | 6920 | 10851 |
| 2987 | 99-21441-420 | A | G | A | 6921 | 10852 |
| 2988 | 99-21444-227 | T | C | S | 6922 | 10853 |
| 2989 | 99-21448-361 | A | G | A | 6923 | 10854 |
| 2990 | 99-21461-375 | C | T | S | 6924 | 10855 |
| 2991 | 99-21463-258 | A | G | A | 6925 | 10856 |
| 2992 | 99-21465-58 | C | A | S | 6926 | 10857 |
| 2993 | 99-21486-88 | C | A | S | 6927 | 10858 |
| 2994 | 99-21492-310 | C | T | S | 6928 | 10859 |
| 2995 | 99-21502-211 | G | A | A | 6929 | 10860 |
| 2996 | 99-21508-131 | C | A | S | 6930 | 10861 |
| 2997 | 99-21510-466 | T | A | S | 6931 | 10862 |
| 2998 | 99-21512-165 | A | T | S | 6932 | 10863 |
| 2999 | 99-21516-293 | G | T | A | 6933 | 10864 |
| 3000 | 99-21533-445 | C | T | S | 6934 | 10865 |
| 3001 | 99-21560-376 | G | A | A | 6935 | 10866 |
| 3002 | 99-21561-41 | T | C | S | 6936 | 10867 |
| 3003 | 99-21566-152 | C | T | S | 6937 | 10868 |
| 3004 | 99-21578-105 | T | C | S | 6938 | 10869 |
| 3005 | 99-21580-141 | A | G | A | 6939 | 10870 |
| 3006 | 99-21591-181 | T | G | A | 6940 | 10871 |
| 3007 | 99-21592-43 | C | T | S | 6941 | 10872 |
| 3008 | 99-21607-114 | A | G | A | 6942 | 10873 |
| 3009 | 99-21615-133 | C | T | S | 6943 | 10874 |
| 3010 | 99-21657-161 | T | C | S | 6944 | 10875 |
| 3011 | 99-21664-278 | G | T | A | 6945 | 10876 |
| 3012 | 99-21666-96 | C | A | S | 6946 | 10877 |
| 3013 | 99-21673-106 | A | T | S | 6947 | 10878 |
| 3014 | 99-21674-245 | G | C | S | 6948 | 10879 |
| 3015 | 99-21687-313 | G | A | A | 6949 | 10880 |
| 3016 | 99-21690-162 | A | G | A | 6950 | 10881 |
| 3017 | 99-21693-368 | C | T | S | 6951 | 10882 |
| 3018 | 99-21699-149 | G | C | S | 6952 | 10883 |
| 3019 | 99-21703-36 | G | A | A | 6953 | 10884 |
| 3020 | 99-21705-306 | T | G | A | 6954 | 10885 |
| 3021 | 99-21707-429 | C | T | S | 6955 | 10886 |
| 3022 | 99-21710-272 | C | G | S | 6956 | 10887 |
| 3023 | 99-21733-323 | G | C | S | 6957 | 10888 |
| 3024 | 99-21734-183 | C | T | S | 6958 | 10889 |
| 3025 | 99-21742-337 | G | A | A | 6959 | 10890 |
| 3026 | 99-21745-455 | T | C | S | 6960 | 10891 |
| 3027 | 99-21756-230 | T | G | A | 6961 | 10892 |
| 3028 | 99-21759-21 | T | G | A | 6962 | 10893 |
| 3029 | 99-21762-135 | A | C | S | 6963 | 10894 |
| 3030 | 99-21763-52 | A | G | A | 6964 | 10895 |
| 3031 | 99-21765-111 | A | T | S | 6965 | 10896 |
| 3032 | 99-21767-392 | T | A | S | 6966 | 10897 |
| 3033 | 99-21771-144 | G | A | A | 6967 | 10898 |
| 3034 | 99-21775-466 | A | T | S | 6968 | 10899 |
| 3035 | 99-21787-348 | A | G | A | 6969 | 10900 |
| 3036 | 99-21790-161 | G | A | A | 6970 | 10901 |
| 3037 | 99-21791-364 | T | C | S | 6971 | 10902 |
| 3038 | 99-21800-310 | A | G | A | 6972 | 10903 |
| 3039 | 99-21801-123 | T | C | S | 6973 | 10904 |
| 3040 | 99-21804-310 | T | C | S | 6974 | 10905 |
| 3041 | 99-21810-222 | G | A | A | 6975 | 10906 |
| 3042 | 99-21811-209 | T | C | S | 6976 | 10907 |
| 3043 | 99-21827-155 | T | C | S | 6977 | 10908 |
| 3044 | 99-21829-261 | C | T | S | 6978 | 10909 |
| 3045 | 99-21831-311 | A | G | A | 6979 | 10910 |
| 3046 | 99-21838-153 | A | G | A | 6980 | 10911 |
| 3047 | 99-21844-165 | G | A | A | 6981 | 10912 |
| 3048 | 99-21846-327 | C | T | S | 6982 | 10913 |
| 3049 | 99-21874-311 | G | T | A | 6983 | 10914 |
| 3050 | 99-21880-331 | C | T | S | 6984 | 10915 |
| 3051 | 99-21881-152 | T | C | S | 6985 | 10916 |
| 3052 | 99-21889-219 | G | A | A | 6986 | 10917 |
| 3053 | 99-21893-388 | G | A | A | 6987 | 10918 |
| 3054 | 99-21896-345 | A | G | A | 6988 | 10919 |
| 3055 | 99-21898-102 | T | A | S | 6989 | 10920 |
| 3056 | 99-21901-331 | G | A | A | 6990 | 10921 |
| 3057 | 99-21913-483 | A | G | A | 6991 | 10922 |
| 3058 | 99-21916-359 | A | G | A | 6992 | 10923 |
| 3059 | 99-21917-84 | G | C | S | 6993 | 10924 |
| 3060 | 99-21919-38 | A | G | A | 6994 | 10925 |
| 3061 | 99-21921-338 | T | C | S | 6995 | 10926 |
| 3062 | 99-21943-413 | C | T | S | 6996 | 10927 |
| 3063 | 99-21948-237 | C | T | S | 6997 | 10928 |
| 3064 | 99-21950-107 | G | C | S | 6998 | 10929 |
| 3065 | 99-21952-76 | T | C | A | 6999 | 10930 |
| 3066 | 99-21968-150 | G | A | A | 7000 | 10931 |
| 3067 | 99-21969-425 | T | G | A | 7001 | 10932 |
| 3068 | 99-22008-325 | C | T | S | 7002 | 10933 |
| 3069 | 99-22098-101 | C | G | S | 7003 | 10934 |
| 3070 | 99-22155-199 | T | C | S | 7004 | 10935 |
| 3071 | 99-22181-171 | G | A | A | 7005 | 10936 |
| 3072 | 99-22187-261 | C | T | S | 7006 | 10937 |
| 3073 | 99-22190-369 | T | C | S | 7007 | 10938 |
| 3074 | 99-22202-58 | T | C | S | 7008 | 10939 |
| 3075 | 99-22204-391 | T | C | S | 7009 | 10940 |
| 3076 | 99-22206-455 | C | G | S | 7010 | 10941 |
| 3077 | 99-22213-333 | T | A | S | 7011 | 10942 |
| 3078 | 99-22355-213 | T | A | S | 7012 | 10943 |
| 3079 | 99-22363-268 | A | G | A | 7013 | 10944 |
| 3080 | 99-22375-353 | G | A | A | 7014 | 10945 |
| 3081 | 99-22405-335 | C | T | S | 7015 | 10946 |
| 3082 | 99-2251-151 | G | A | A | 7016 | 10947 |
| 3083 | 99-22530-48 | C | T | S | 7017 | 10948 |
| 3084 | 99-22537-280 | A | G | A | 7018 | 10949 |
| 3085 | 99-22567-243 | C | G | S | 7019 | 10950 |
| 3086 | 99-22572-72 | A | G | A | 7020 | 10951 |
| 3087 | 99-22593-64 | C | T | S | 7021 | 10952 |
| 3088 | 99-22706-367 | T | C | S | 7022 | 10953 |
| 3089 | 99-22729-352 | T | A | S | 7023 | 10954 |
| 3090 | 99-22768-113 | G | T | A | 7024 | 10955 |
| 3091 | 99-22814-349 | C | T | S | 7025 | 10956 |
| 3092 | 99-22818-33 | C | T | S | 7026 | 10957 |
| 3093 | 99-22826-311 | C | T | S | 7027 | 10958 |
| 3094 | 99-22851-121 | A | G | A | 7028 | 10959 |
| 3095 | 99-23113-388 | C | T | S | 7029 | 10960 |
| 3096 | 99-23188-227 | T | C | S | 7030 | 10961 |
| 3097 | 99-23240-326 | C | A | S | 7031 | 10962 |
| 3098 | 99-23246-66 | A | G | A | 7032 | 10963 |
| 3099 | 99-23248-308 | A | G | A | 7033 | 10964 |
| 3100 | 99-23249-262 | A | G | A | 7034 | 10965 |
| 3101 | 99-23274-182 | C | T | S | 7035 | 10966 |

TABLE 1-continued

| SEQ ID No. | Marker Name | Allele 1ST | Allele 2ND | Preferred microseq. primer | Amplification primer Upstream (PU) | Amplification primer Downstream (RP) |
|---|---|---|---|---|---|---|
| 3102 | 99-2333-423 | T | G | A | 7036 | 10967 |
| 3103 | 99-2341-485 | C | T | S | 7037 | 10968 |
| 3104 | 99-2342-217 | C | T | S | 7038 | 10969 |
| 3105 | 99-23427-283 | G | A | A | 7039 | 10970 |
| 3106 | 99-23442-190 | T | C | S | 7040 | 10971 |
| 3107 | 99-23544-340 | C | A | S | 7041 | 10972 |
| 3108 | 99-23549-78 | G | A | A | 7042 | 10973 |
| 3109 | 99-23558-98 | A | G | A | 7043 | 10974 |
| 3110 | 99-23565-252 | G | C | S | 7044 | 10975 |
| 3111 | 99-23589-198 | A | C | S | 7045 | 10976 |
| 3112 | 99-23590-205 | C | T | S | 7046 | 10977 |
| 3113 | 99-23621-189 | G | A | A | 7047 | 10978 |
| 3114 | 99-23641-159 | G | A | A | 7048 | 10979 |
| 3115 | 99-23652-244 | G | A | A | 7049 | 10980 |
| 3116 | 99-23696-164 | C | T | S | 7050 | 10981 |
| 3117 | 99-23701-104 | C | T | S | 7051 | 10982 |
| 3118 | 99-23702-437 | G | A | A | 7052 | 10983 |
| 3119 | 99-2371-93 | A | C | S | 7053 | 10984 |
| 3120 | 99-23711-455 | C | T | S | 7054 | 10985 |
| 3121 | 99-23730-202 | T | C | S | 7055 | 10986 |
| 3122 | 99-23736-314 | G | A | S | 7056 | 10987 |
| 3123 | 99-23813-476 | C | T | S | 7057 | 10988 |
| 3124 | 99-23821-176 | G | C | S | 7058 | 10989 |
| 3125 | 99-23844-382 | A | C | S | 7059 | 10990 |
| 3126 | 99-23858-51 | G | T | A | 7060 | 10991 |
| 3127 | 99-23860-146 | G | C | S | 7061 | 10992 |
| 3128 | 99-23876-265 | A | C | S | 7062 | 10993 |
| 3129 | 99-23878-400 | C | A | S | 7063 | 10994 |
| 3130 | 99-23880-268 | G | A | A | 7064 | 10995 |
| 3131 | 99-23887-103 | G | A | A | 7065 | 10996 |
| 3132 | 99-23889-342 | A | G | A | 7066 | 10997 |
| 3133 | 99-23894-339 | T | C | S | 7067 | 10998 |
| 3134 | 99-23895-40 | T | C | S | 7068 | 10999 |
| 3135 | 99-23902-103 | T | C | S | 7069 | 11000 |
| 3136 | 99-23912-116 | G | C | S | 7070 | 11001 |
| 3137 | 99-23915-69 | A | G | A | 7071 | 11002 |
| 3138 | 99-23918-179 | T | C | S | 7072 | 11003 |
| 3139 | 99-23934-353 | G | A | A | 7073 | 11004 |
| 3140 | 99-23936-216 | T | C | S | 7074 | 11005 |
| 3141 | 99-23938-414 | G | A | A | 7075 | 11006 |
| 3142 | 99-23943-245 | A | G | A | 7076 | 11007 |
| 3143 | 99-23960-298 | T | C | A | 7077 | 11008 |
| 3144 | 99-23965-360 | C | T | A | 7078 | 11009 |
| 3145 | 99-23977-141 | G | A | S | 7079 | 11010 |
| 3146 | 99-23987-115 | C | T | A | 7080 | 11011 |
| 3147 | 99-23988-441 | C | T | A | 7081 | 11012 |
| 3148 | 99-23995-407 | A | G | S | 7082 | 11013 |
| 3149 | 99-24000-316 | C | T | S | 7083 | 11014 |
| 3150 | 99-24003-172 | T | C | A | 7084 | 11015 |
| 3151 | 99-24004-200 | A | G | S | 7085 | 11016 |
| 3152 | 99-24007-362 | T | C | A | 7086 | 11017 |
| 3153 | 99-24020-379 | C | A | S | 7087 | 11018 |
| 3154 | 99-24038-103 | C | T | A | 7088 | 11019 |
| 3155 | 99-24063-363 | T | C | S | 7089 | 11020 |
| 3156 | 99-24073-384 | G | A | A | 7090 | 11021 |
| 3157 | 99-24075-45 | T | G | A | 7091 | 11022 |
| 3158 | 99-24079-268 | C | A | S | 7092 | 11023 |
| 3159 | 99-24084-110 | G | A | A | 7093 | 11024 |
| 3160 | 99-24092-209 | A | G | A | 7094 | 11025 |
| 3161 | 99-24096-386 | T | A | S | 7095 | 11026 |
| 3162 | 99-24105-247 | C | T | S | 7096 | 11027 |
| 3163 | 99-24113-332 | A | G | A | 7097 | 11028 |
| 3164 | 99-24117-169 | A | G | A | 7098 | 11029 |
| 3165 | 99-24119-368 | T | G | A | 7099 | 11030 |
| 3166 | 99-24123-125 | A | G | A | 7100 | 11031 |
| 3167 | 99-24140-394 | G | A | A | 7101 | 11032 |
| 3168 | 99-24148-332 | A | C | S | 7102 | 11033 |
| 3169 | 99-24152-268 | C | T | S | 7103 | 11034 |
| 3170 | 99-24155-271 | A | C | S | 7104 | 11035 |
| 3171 | 99-24156-107 | C | T | S | 7105 | 11036 |
| 3172 | 99-24167-85 | A | C | S | 7106 | 11037 |
| 3173 | 99-24175-218 | A | G | A | 7107 | 11038 |
| 3174 | 99-24180-390 | A | G | A | 7108 | 11039 |
| 3175 | 99-24182-326 | C | A | S | 7109 | 11040 |
| 3176 | 99-24185-446 | T | C | S | 7110 | 11041 |
| 3177 | 99-24187-142 | A | G | A | 7111 | 11042 |
| 3178 | 99-24190-231 | G | C | S | 7112 | 11043 |
| 3179 | 99-24202-433 | C | G | S | 7113 | 11044 |
| 3180 | 99-24204-486 | T | C | S | 7114 | 11045 |
| 3181 | 99-24208-292 | T | A | S | 7115 | 11046 |
| 3182 | 99-24210-111 | G | A | A | 7116 | 11047 |
| 3183 | 99-24217-206 | T | C | S | 7117 | 11048 |
| 3184 | 99-24225-439 | A | G | A | 7118 | 11049 |
| 3185 | 99-24228-386 | G | C | S | 7119 | 11050 |
| 3186 | 99-24232-419 | A | G | A | 7120 | 11051 |
| 3187 | 99-24234-352 | A | G | S | 7121 | 11052 |
| 3188 | 99-24369-263 | G | C | S | 7122 | 11053 |
| 3189 | 99-24397-315 | G | C | S | 7123 | 11054 |
| 3190 | 99-24408-202 | A | G | S | 7124 | 11055 |
| 3191 | 99-2441-512 | A | G | A | 7125 | 11056 |
| 3192 | 99-24412-279 | C | T | A | 7126 | 11057 |
| 3193 | 99-24415-85 | T | C | A | 7127 | 11058 |
| 3194 | 99-24470-168 | G | A | S | 7128 | 11059 |
| 3195 | 99-24472-179 | A | G | S | 7129 | 11060 |
| 3196 | 99-24480-44 | A | C | S | 7130 | 11061 |
| 3197 | 99-24485-55 | G | T | A | 7131 | 11062 |
| 3198 | 99-24490-363 | A | G | S | 7132 | 11063 |
| 3199 | 99-24492-351 | C | G | S | 7133 | 11064 |
| 3200 | 99-24581-253 | G | A | S | 7134 | 11065 |
| 3201 | 99-24591-33 | T | C | A | 7135 | 11066 |
| 3202 | 99-24592-55 | C | T | A | 7136 | 11067 |
| 3203 | 99-24745-413 | T | C | A | 7137 | 11068 |
| 3204 | 99-24753-182 | G | A | S | 7138 | 11069 |
| 3205 | 99-24768-233 | C | T | S | 7139 | 11070 |
| 3206 | 99-24855-180 | C | T | A | 7140 | 11071 |
| 3207 | 99-24863-199 | C | T | A | 7141 | 11072 |
| 3208 | 99-24867-219 | G | A | S | 7142 | 11073 |
| 3209 | 99-24871-435 | A | G | S | 7143 | 11074 |
| 3210 | 99-24889-311 | T | A | S | 7144 | 11075 |
| 3211 | 99-24897-276 | C | G | S | 7145 | 11076 |
| 3212 | 99-24904-187 | T | C | A | 7146 | 11077 |
| 3213 | 99-24909-440 | A | G | S | 7147 | 11078 |
| 3214 | 99-24917-250 | G | A | S | 7148 | 11079 |
| 3215 | 99-24930-299 | A | G | A | 7149 | 11080 |
| 3216 | 99-24936-332 | G | T | A | 7150 | 11081 |
| 3217 | 99-24965-416 | G | C | S | 7151 | 11082 |
| 3218 | 99-24966-423 | C | T | A | 7152 | 11083 |
| 3219 | 99-25020-395 | C | G | S | 7153 | 11084 |
| 3220 | 99-25362-247 | T | C | S | 7154 | 11085 |
| 3221 | 99-25394-261 | T | C | S | 7155 | 11086 |
| 3222 | 99-25406-54 | G | C | S | 7156 | 11087 |
| 3223 | 99-25446-121 | C | A | S | 7157 | 11088 |
| 3224 | 99-25496-221 | C | T | A | 7158 | 11089 |
| 3225 | 99-25497-242 | G | A | S | 7159 | 11090 |
| 3226 | 99-2559-253 | T | G | A | 7160 | 11091 |
| 3227 | 99-25654-281 | G | A | S | 7161 | 11092 |
| 3228 | 99-2566-112 | A | G | A | 7162 | 11093 |
| 3229 | 99-2567-329 | T | G | A | 7163 | 11094 |
| 3230 | 99-2571-242 | G | A | A | 7164 | 11095 |
| 3231 | 99-25738-218 | C | T | A | 7165 | 11096 |
| 3232 | 99-25755-364 | A | G | S | 7166 | 11097 |
| 3233 | 99-25834-70 | T | G | A | 7167 | 11098 |
| 3234 | 99-25843-256 | A | C | S | 7168 | 11099 |
| 3235 | 99-26051-273 | G | A | A | 7169 | 11100 |
| 3236 | 99-26058-275 | G | C | S | 7170 | 11101 |
| 3237 | 99-26074-400 | A | C | S | 7171 | 11102 |
| 3238 | 99-26076-376 | G | A | A | 7172 | 11103 |
| 3239 | 99-2630-67 | G | A | A | 7173 | 11104 |
| 3240 | 99-2633-129 | C | A | S | 7174 | 11105 |
| 3241 | 99-2634-341 | G | A | A | 7175 | 11106 |
| 3242 | 99-2636-64 | A | T | S | 7176 | 11107 |
| 3243 | 99-2642-255 | A | G | A | 7177 | 11108 |
| 3244 | 99-2645-118 | T | G | A | 7178 | 11109 |
| 3245 | 99-2647-368 | G | A | A | 7179 | 11110 |
| 3246 | 99-2649-107 | T | A | S | 7180 | 11111 |
| 3247 | 99-2711-269 | A | G | A | 7181 | 11112 |

TABLE 1-continued

| SEQ ID No. | Marker Name | Allele 1ST | Allele 2ND | Preferred microseq. primer | Amplification primer Upstream (PU) | Amplification primer Downstream (RP) |
|---|---|---|---|---|---|---|
| 3248 | 99-2712-52 | C | T | S | 7182 | 11113 |
| 3249 | 99-2718-202 | C | T | S | 7183 | 11114 |
| 3250 | 99-2719-419 | T | C | S | 7184 | 11115 |
| 3251 | 99-2726-364 | C | G | S | 7185 | 11116 |
| 3252 | 99-2734-400 | T | G | A | 7186 | 11117 |
| 3253 | 99-2740-351 | T | G | A | 7187 | 11118 |
| 3254 | 99-2752-213 | C | G | S | 7188 | 11119 |
| 3255 | 99-2760-182 | A | G | A | 7189 | 11120 |
| 3256 | 99-2761-223 | A | G | A | 7190 | 11121 |
| 3257 | 99-2765-279 | A | G | A | 7191 | 11122 |
| 3258 | 99-2790-217 | T | C | S | 7192 | 11123 |
| 3259 | 99-2797-399 | C | T | S | 7193 | 11124 |
| 3260 | 99-2816-62 | G | A | A | 7194 | 11125 |
| 3261 | 99-2817-88 | G | C | A | 7195 | 11126 |
| 3262 | 99-2819-108 | A | G | A | 7196 | 11127 |
| 3263 | 99-2820-199 | A | G | A | 7197 | 11128 |
| 3264 | 99-2832-152 | C | T | S | 7198 | 11129 |
| 3265 | 99-2868-277 | G | C | S | 7199 | 11130 |
| 3266 | 99-2870-70 | A | G | A | 7200 | 11131 |
| 3267 | 99-2881-61 | T | A | S | 7201 | 11132 |
| 3268 | 99-2895-47 | A | G | A | 7202 | 11133 |
| 3269 | 99-2903-265 | A | T | S | 7203 | 11134 |
| 3270 | 99-2906-80 | C | T | S | 7204 | 11135 |
| 3271 | 99-2914-48 | A | G | A | 7205 | 11136 |
| 3272 | 99-2922-171 | G | A | A | 7206 | 11137 |
| 3273 | 99-2924-183 | T | C | S | 7207 | 11138 |
| 3274 | 99-2926-184 | G | A | A | 7208 | 11139 |
| 3275 | 99-2928-52 | G | A | A | 7209 | 11140 |
| 3276 | 99-2938-83 | T | C | S | 7210 | 11141 |
| 3277 | 99-2943-230 | T | G | A | 7211 | 11142 |
| 3278 | 99-2944-351 | C | T | S | 7212 | 11143 |
| 3279 | 99-295-355 | T | C | S | 7213 | 11144 |
| 3280 | 99-2954-160 | C | G | S | 7214 | 11145 |
| 3281 | 99-2956-239 | C | T | S | 7215 | 11146 |
| 3282 | 99-2970-318 | G | C | S | 7216 | 11147 |
| 3283 | 99-2978-135 | C | A | S | 7217 | 11148 |
| 3284 | 99-2981-53 | T | C | S | 7218 | 11149 |
| 3285 | 99-2988-243 | C | T | S | 7219 | 11150 |
| 3286 | 99-2989-345 | C | A | S | 7220 | 11151 |
| 3287 | 99-2991-256 | G | A | A | 7221 | 11152 |
| 3288 | 99-2995-168 | C | T | S | 7222 | 11153 |
| 3289 | 99-2999-371 | C | T | S | 7223 | 11154 |
| 3290 | 99-3013-250 | A | T | S | 7224 | 11155 |
| 3291 | 99-3018-50 | A | G | A | 7225 | 11156 |
| 3292 | 99-3019-316 | A | T | S | 7226 | 11157 |
| 3293 | 99-3020-369 | A | G | A | 7227 | 11158 |
| 3294 | 99-3021-290 | A | G | A | 7228 | 11159 |
| 3295 | 99-3044-216 | C | T | S | 7229 | 11160 |
| 3296 | 99-3045-108 | C | T | S | 7230 | 11161 |
| 3297 | 99-3046-91 | T | C | S | 7231 | 11162 |
| 3298 | 99-3047-395 | G | A | A | 7232 | 11163 |
| 3299 | 99-3058-420 | T | A | S | 7233 | 11164 |
| 3300 | 99-306-119 | G | A | A | 7234 | 11165 |
| 3301 | 99-3061-369 | A | G | A | 7235 | 11166 |
| 3302 | 99-3106-272 | G | A | A | 7236 | 11167 |
| 3303 | 99-3108-156 | A | T | S | 7237 | 11168 |
| 3304 | 99-3109-402 | G | A | A | 7238 | 11169 |
| 3305 | 99-3110-321 | C | T | S | 7239 | 11170 |
| 3306 | 99-312-311 | C | T | S | 7240 | 11171 |
| 3307 | 99-3129-113 | T | A | S | 7241 | 11172 |
| 3308 | 99-3132-158 | A | G | A | 7242 | 11173 |
| 3309 | 99-3144-112 | A | G | A | 7243 | 11174 |
| 3310 | 99-3147-24 | C | G | S | 7244 | 11175 |
| 3311 | 99-3153-190 | C | T | S | 7245 | 11176 |
| 3312 | 99-3154-110 | T | C | S | 7246 | 11177 |
| 3313 | 99-3156-251 | T | C | S | 7247 | 11178 |
| 3314 | 99-3167-227 | A | G | A | 7248 | 11179 |
| 3315 | 99-3195-71 | G | A | A | 7249 | 11180 |
| 3316 | 99-3217-274 | G | A | A | 7250 | 11181 |
| 3317 | 99-3224-232 | A | G | A | 7251 | 11182 |
| 3318 | 99-3231-109 | T | A | S | 7252 | 11183 |
| 3319 | 99-3234-274 | A | C | S | 7253 | 11184 |
| 3320 | 99-325-226 | A | C | S | 7254 | 11185 |
| 3321 | 99-3266-193 | G | A | A | 7255 | 11186 |
| 3322 | 99-3276-195 | C | A | S | 7256 | 11187 |
| 3323 | 99-3279-337 | T | C | S | 7257 | 11188 |
| 3324 | 99-3293-300 | T | G | A | 7258 | 11189 |
| 3325 | 99-3296-101 | T | A | S | 7259 | 11190 |
| 3326 | 99-3299-211 | C | T | S | 7260 | 11191 |
| 3327 | 99-3305-272 | A | C | S | 7261 | 11192 |
| 3328 | 99-3335-53 | C | T | S | 7262 | 11193 |
| 3329 | 99-3337-294 | C | T | S | 7263 | 11194 |
| 3330 | 99-3342-103 | G | A | A | 7264 | 11195 |
| 3331 | 99-3347-226 | T | A | S | 7265 | 11196 |
| 3332 | 99-3349-124 | A | C | S | 7266 | 11197 |
| 3333 | 99-3353-350 | T | C | S | 7267 | 11198 |
| 3334 | 99-3356-345 | A | G | A | 7268 | 11199 |
| 3335 | 99-3368-277 | C | T | S | 7269 | 11200 |
| 3336 | 99-3373-253 | C | G | S | 7270 | 11201 |
| 3337 | 99-3374-274 | G | A | A | 7271 | 11202 |
| 3338 | 99-3385-197 | C | T | S | 7272 | 11203 |
| 3339 | 99-3390-328 | G | A | A | 7273 | 11204 |
| 3340 | 99-3391-160 | C | T | S | 7274 | 11205 |
| 3341 | 99-3393-245 | A | G | A | 7275 | 11206 |
| 3342 | 99-3398-196 | T | C | S | 7276 | 11207 |
| 3343 | 99-3399-449 | C | T | S | 7277 | 11208 |
| 3344 | 99-3400-83 | G | A | A | 7278 | 11209 |
| 3345 | 99-3414-112 | G | A | A | 7279 | 11210 |
| 3346 | 99-3415-215 | G | A | A | 7280 | 11211 |
| 3347 | 99-3426-270 | C | T | S | 7281 | 11212 |
| 3348 | 99-3428-366 | A | G | A | 7282 | 11213 |
| 3349 | 99-3445-239 | G | C | S | 7283 | 11214 |
| 3350 | 99-3453-138 | A | G | A | 7284 | 11215 |
| 3351 | 99-3460-337 | C | T | S | 7285 | 11216 |
| 3352 | 99-3462-117 | C | T | S | 7286 | 11217 |
| 3353 | 99-3468-272 | A | G | A | 7287 | 11218 |
| 3354 | 99-3469-313 | C | G | S | 7288 | 11219 |
| 3355 | 99-3473-309 | C | G | S | 7289 | 11220 |
| 3356 | 99-3474-272 | A | G | S | 7290 | 11221 |
| 3357 | 99-3478-199 | G | A | A | 7291 | 11222 |
| 3358 | 99-3479-293 | T | C | S | 7292 | 11223 |
| 3359 | 99-3482-225 | A | G | A | 7293 | 11224 |
| 3360 | 99-3483-252 | T | C | S | 7294 | 11225 |
| 3361 | 99-3485-245 | T | A | S | 7295 | 11226 |
| 3362 | 99-3511-130 | G | A | A | 7296 | 11227 |
| 3363 | 99-3519-374 | G | A | A | 7297 | 11228 |
| 3364 | 99-3522-210 | A | G | A | 7298 | 11229 |
| 3365 | 99-3523-270 | A | C | S | 7299 | 11230 |
| 3366 | 99-3524-403 | T | A | S | 7300 | 11231 |
| 3367 | 99-3542-336 | G | T | A | 7301 | 11232 |
| 3368 | 99-3556-129 | T | G | A | 7302 | 11233 |
| 3369 | 99-3563-121 | C | T | S | 7303 | 11234 |
| 3370 | 99-3580-122 | C | G | S | 7304 | 11235 |
| 3371 | 99-3588-188 | T | A | S | 7305 | 11236 |
| 3372 | 99-3589-203 | C | T | S | 7306 | 11237 |
| 3373 | 99-3596-147 | C | T | S | 7307 | 11238 |
| 3374 | 99-36-69 | C | T | S | 7308 | 11239 |
| 3375 | 99-3601-226 | T | C | S | 7309 | 11240 |
| 3376 | 99-3603-80 | T | A | S | 7310 | 11241 |
| 3377 | 99-3604-91 | A | G | A | 7311 | 11242 |
| 3378 | 99-3619-330 | C | T | S | 7312 | 11243 |
| 3379 | 99-3620-314 | G | A | A | 7313 | 11244 |
| 3380 | 99-3628-31 | G | A | A | 7314 | 11245 |
| 3381 | 99-3629-219 | G | A | A | 7315 | 11246 |
| 3382 | 99-3631-159 | C | T | S | 7316 | 11247 |
| 3383 | 99-3638-259 | A | C | S | 7317 | 11248 |
| 3384 | 99-3641-230 | C | A | S | 7318 | 11249 |
| 3385 | 99-3666-280 | G | A | A | 7319 | 11250 |
| 3386 | 99-3667-190 | G | A | A | 7320 | 11251 |
| 3387 | 99-3677-196 | T | A | S | 7321 | 11252 |
| 3388 | 99-3680-274 | C | G | S | 7322 | 11253 |
| 3389 | 99-3689-50 | A | G | A | 7323 | 11254 |
| 3390 | 99-3690-355 | G | C | S | 7324 | 11255 |
| 3391 | 99-3699-230 | G | A | A | 7325 | 11256 |
| 3392 | 99-3702-226 | T | A | S | 7326 | 11257 |
| 3393 | 99-3703-331 | C | T | S | 7327 | 11258 |

TABLE 1-continued

| SEQ ID No. | Marker Name | Allele 1ST | Allele 2ND | Preferred microseq. primer | Amplification primer Upstream (PU) | Amplification primer Downstream (RP) |
|---|---|---|---|---|---|---|
| 3394 | 99-3705-195 | G | A | A | 7328 | 11259 |
| 3395 | 99-3709-366 | T | C | S | 7329 | 11260 |
| 3396 | 99-3717-68 | A | G | A | 7330 | 11261 |
| 3397 | 99-3728-341 | T | C | S | 7331 | 11262 |
| 3398 | 99-3739-215 | G | A | A | 7332 | 11263 |
| 3399 | 99-3746-337 | C | G | S | 7333 | 11264 |
| 3400 | 99-3749-174 | C | T | S | 7334 | 11265 |
| 3401 | 99-3752-210 | C | T | S | 7335 | 11266 |
| 3402 | 99-3760-59 | A | G | A | 7336 | 11267 |
| 3403 | 99-3761-329 | C | T | S | 7337 | 11268 |
| 3404 | 99-3764-198 | C | T | S | 7338 | 11269 |
| 3405 | 99-3765-279 | A | G | A | 7339 | 11270 |
| 3406 | 99-377-306 | G | A | S | 7340 | 11271 |
| 3407 | 99-3773-337 | T | C | S | 7341 | 11272 |
| 3408 | 99-3774-351 | A | G | A | 7342 | 11273 |
| 3409 | 99-3775-98 | G | A | A | 7343 | 11274 |
| 3410 | 99-3778-97 | T | A | S | 7344 | 11275 |
| 3411 | 99-3789-293 | A | G | A | 7345 | 11276 |
| 3412 | 99-3792-294 | A | G | A | 7346 | 11277 |
| 3413 | 99-3802-197 | C | T | S | 7347 | 11278 |
| 3414 | 99-3805-125 | A | G | A | 7348 | 11279 |
| 3415 | 99-3812-243 | T | G | A | 7349 | 11280 |
| 3416 | 99-3813-122 | T | C | S | 7350 | 11281 |
| 3417 | 99-3857-261 | A | G | A | 7351 | 11282 |
| 3418 | 99-3862-153 | A | G | A | 7352 | 11283 |
| 3419 | 99-3875-138 | A | C | S | 7353 | 11284 |
| 3420 | 99-3888-309 | G | A | A | 7354 | 11285 |
| 3421 | 99-3893-108 | A | C | S | 7355 | 11286 |
| 3422 | 99-3941-107 | A | G | A | 7356 | 11287 |
| 3423 | 99-3944-247 | G | T | A | 7357 | 11288 |
| 3424 | 99-3953-77 | G | A | A | 7358 | 11289 |
| 3425 | 99-3954-362 | G | C | S | 7359 | 11290 |
| 3426 | 99-3978-146 | C | T | S | 7360 | 11291 |
| 3427 | 99-3981-156 | A | G | A | 7361 | 11292 |
| 3428 | 99-3992-185 | C | T | S | 7362 | 11293 |
| 3429 | 99-4001-330 | C | T | S | 7363 | 11294 |
| 3430 | 99-4009-232 | C | T | S | 7364 | 11295 |
| 3431 | 99-4025-300 | C | T | S | 7365 | 11296 |
| 3432 | 99-4052-415 | G | T | A | 7366 | 11297 |
| 3433 | 99-4064-346 | A | C | S | 7367 | 11298 |
| 3434 | 99-4065-20 | A | G | A | 7368 | 11299 |
| 3435 | 99-4073-307 | C | A | S | 7369 | 11300 |
| 3436 | 99-4076-255 | G | A | A | 7370 | 11301 |
| 3437 | 99-4077-230 | T | C | S | 7371 | 11302 |
| 3438 | 99-4078-212 | G | C | S | 7372 | 11303 |
| 3439 | 99-4079-389 | A | G | A | 7373 | 11304 |
| 3440 | 99-4119-307 | C | T | S | 7374 | 11305 |
| 3441 | 99-4120-253 | C | T | S | 7375 | 11306 |
| 3442 | 99-4122-23 | T | C | S | 7376 | 11307 |
| 3443 | 99-4125-192 | C | A | S | 7377 | 11308 |
| 3444 | 99-4131-288 | T | C | S | 7378 | 11309 |
| 3445 | 99-4138-360 | A | C | S | 7379 | 11310 |
| 3446 | 99-4139-128 | C | T | S | 7380 | 11311 |
| 3447 | 99-4140-254 | C | T | S | 7381 | 11312 |
| 3448 | 99-4182-113 | A | G | A | 7382 | 11313 |
| 3449 | 99-4193-384 | A | G | A | 7383 | 11314 |
| 3450 | 99-4194-336 | T | C | S | 7384 | 11315 |
| 3451 | 99-4199-339 | G | A | A | 7385 | 11316 |
| 3452 | 99-4201-501 | G | T | A | 7386 | 11317 |
| 3453 | 99-4202-223 | T | C | S | 7387 | 11318 |
| 3454 | 99-4203-110 | T | C | S | 7388 | 11319 |
| 3455 | 99-4207-210 | G | A | A | 7389 | 11320 |
| 3456 | 99-4218-24 | G | A | A | 7390 | 11321 |
| 3457 | 99-4220-241 | T | C | S | 7391 | 11322 |
| 3458 | 99-4225-339 | T | C | S | 7392 | 11323 |
| 3459 | 99-4231-139 | T | C | S | 7393 | 11324 |
| 3460 | 99-4232-105 | A | G | A | 7394 | 11325 |
| 3461 | 99-4233-261 | A | G | A | 7395 | 11326 |
| 3462 | 99-4238-181 | T | C | S | 7396 | 11327 |
| 3463 | 99-4251-311 | T | C | S | 7397 | 11328 |
| 3464 | 99-4266-313 | A | G | A | 7398 | 11329 |
| 3465 | 99-4272-418 | G | A | S | 7399 | 11330 |
| 3466 | 99-4283-257 | G | A | A | 7400 | 11331 |
| 3467 | 99-4284-200 | A | C | S | 7401 | 11332 |
| 3468 | 99-4285-370 | C | T | S | 7402 | 11333 |
| 3469 | 99-4290-131 | G | A | A | 7403 | 11334 |
| 3470 | 99-4293-344 | C | T | S | 7404 | 11335 |
| 3471 | 99-4296-156 | T | A | S | 7405 | 11336 |
| 3472 | 99-4312-338 | A | G | A | 7406 | 11337 |
| 3473 | 99-4323-311 | T | C | S | 7407 | 11338 |
| 3474 | 99-4325-87 | T | C | S | 7408 | 11339 |
| 3475 | 99-4332-136 | C | A | S | 7409 | 11340 |
| 3476 | 99-4335-371 | C | G | S | 7410 | 11341 |
| 3477 | 99-4336-171 | C | T | S | 7411 | 11342 |
| 3478 | 99-4337-369 | A | G | A | 7412 | 11343 |
| 3479 | 99-4339-180 | T | C | S | 7413 | 11344 |
| 3480 | 99-4358-133 | A | G | A | 7414 | 11345 |
| 3481 | 99-4364-360 | C | T | S | 7415 | 11346 |
| 3482 | 99-4398-167 | T | A | S | 7416 | 11347 |
| 3483 | 99-4399-228 | T | A | S | 7417 | 11348 |
| 3484 | 99-4404-384 | G | A | A | 7418 | 11349 |
| 3485 | 99-4406-115 | A | G | A | 7419 | 11350 |
| 3486 | 99-4435-203 | A | G | A | 7420 | 11351 |
| 3487 | 99-4448-174 | T | C | S | 7421 | 11352 |
| 3488 | 99-4455-357 | T | A | S | 7422 | 11353 |
| 3489 | 99-4458-59 | A | G | A | 7423 | 11354 |
| 3490 | 99-4467-39 | T | C | S | 7424 | 11355 |
| 3491 | 99-4468-130 | C | A | S | 7425 | 11356 |
| 3492 | 99-4483-333 | C | T | S | 7426 | 11357 |
| 3493 | 99-4534-158 | T | C | S | 7427 | 11358 |
| 3494 | 99-4567-424 | T | C | A | 7428 | 11359 |
| 3495 | 99-4575-226 | C | T | S | 7429 | 11360 |
| 3496 | 99-4580-296 | G | A | A | 7430 | 11361 |
| 3497 | 99-4589-169 | C | T | S | 7431 | 11362 |
| 3498 | 99-4614-72 | A | C | S | 7432 | 11363 |
| 3499 | 99-4619-267 | A | C | S | 7433 | 11364 |
| 3500 | 99-4636-62 | C | T | S | 7434 | 11365 |
| 3501 | 994649-251 | T | A | S | 7435 | 11366 |
| 3502 | 99-468-271 | T | C | S | 7436 | 11367 |
| 3503 | 99-4688-442 | C | G | S | 7437 | 11368 |
| 3504 | 99-4691-400 | A | G | A | 7438 | 11369 |
| 3505 | 99-4692-372 | T | G | A | 7439 | 11370 |
| 3506 | 99-4715-280 | G | A | A | 7440 | 11371 |
| 3507 | 99-4736-164 | C | T | S | 7441 | 11372 |
| 3508 | 99-4744-72 | G | T | A | 7442 | 11373 |
| 3509 | 99-4746-160 | G | T | A | 7443 | 11374 |
| 3510 | 99-4748-76 | C | T | S | 7444 | 11375 |
| 3511 | 99-4755-84 | C | A | S | 7445 | 11376 |
| 3512 | 99-4758-66 | G | A | A | 7446 | 11377 |
| 3513 | 99-4772-80 | C | A | S | 7447 | 11378 |
| 3514 | 99-4791-198 | G | A | S | 7448 | 11379 |
| 3515 | 99-4792-298 | G | A | A | 7449 | 11380 |
| 3516 | 99-4799-209 | C | A | S | 7450 | 11381 |
| 3517 | 99-480-373 | G | A | A | 7451 | 11382 |
| 3518 | 99-4810-454 | A | G | A | 7452 | 11383 |
| 3519 | 99-4825-253 | A | G | A | 7453 | 11384 |
| 3520 | 99-4832-314 | G | A | A | 7454 | 11385 |
| 3521 | 99-4837-337 | C | T | S | 7455 | 11386 |
| 3522 | 99-4856-363 | G | A | A | 7456 | 11387 |
| 3523 | 99-4871-375 | C | T | S | 7457 | 11388 |
| 3524 | 99-4874-285 | C | T | S | 7458 | 11389 |
| 3525 | 99-4885-366 | A | G | A | 7459 | 11390 |
| 3526 | 99-49-41 | G | A | A | 7460 | 11391 |
| 3527 | 99-4903-395 | A | G | A | 7461 | 11392 |
| 3528 | 99-499-294 | C | T | S | 7462 | 11393 |
| 3529 | 99-5059-256 | T | C | S | 7463 | 11394 |
| 3530 | 99-5074-454 | T | C | S | 7464 | 11395 |
| 3531 | 99-5076-173 | C | T | S | 7465 | 11396 |
| 3532 | 99-5098-29 | G | A | A | 7466 | 11397 |
| 3533 | 99-51-263 | G | C | S | 7467 | 11398 |
| 3534 | 99-5112-188 | C | T | S | 7468 | 11399 |
| 3535 | 99-515-151 | T | C | S | 7469 | 11400 |
| 3536 | 99-5166-223 | C | T | S | 7470 | 11401 |
| 3537 | 99-5167-321 | A | T | S | 7471 | 11402 |
| 3538 | 99-5176-230 | T | C | S | 7472 | 11403 |
| 3539 | 99-5240-419 | C | T | S | 7473 | 11404 |

TABLE 1-continued

| SEQ ID No. | Marker Name | Allele 1ST | Allele 2ND | Preferred microseq. primer | Amplification primer Upstream (PU) | Amplification primer Downstream (RP) |
|---|---|---|---|---|---|---|
| 3540 | 99-5329-269 | G | T | S | 7474 | 11405 |
| 3541 | 99-5339-196 | A | G | A | 7475 | 11406 |
| 3542 | 99-5347-394 | T | C | S | 7476 | 11407 |
| 3543 | 99-5397-353 | G | C | A | 7477 | 11408 |
| 3544 | 99-55-233 | C | A | S | 7478 | 11409 |
| 3545 | 99-5549-289 | A | G | A | 7479 | 11410 |
| 3546 | 99-5569-237 | A | G | A | 7480 | 11411 |
| 3547 | 99-5575-330 | C | T | S | 7481 | 11412 |
| 3548 | 99-5602-372 | G | C | S | 7482 | 11413 |
| 3549 | 99-5671-333 | T | C | S | 7483 | 11414 |
| 3550 | 99-568-101 | G | A | S | 7484 | 11415 |
| 3551 | 99-5688-116 | A | G | A | 7485 | 11416 |
| 3552 | 99-5689-391 | G | C | S | 7486 | 11417 |
| 3553 | 99-5715-224 | T | G | A | 7487 | 11418 |
| 3554 | 99-5718-82 | A | G | A | 7488 | 11419 |
| 3555 | 99-5723-291 | A | G | A | 7489 | 11420 |
| 3556 | 99-5747-278 | T | C | S | 7490 | 11421 |
| 3557 | 99-5775-154 | C | T | S | 7491 | 11422 |
| 3558 | 99-5828-235 | T | C | S | 7492 | 11423 |
| 3559 | 99-5846-383 | C | T | S | 7493 | 11424 |
| 3560 | 99-5861-151 | G | A | A | 7494 | 11425 |
| 3561 | 99-59-137 | A | C | S | 7495 | 11426 |
| 3562 | 99-5930-449 | T | A | A | 7496 | 11427 |
| 3563 | 99-5931-330 | G | A | A | 7497 | 11428 |
| 3564 | 99-5967-165 | C | T | S | 7498 | 11429 |
| 3565 | 99-5987-135 | A | G | A | 7499 | 11430 |
| 3566 | 99-5996-279 | T | C | S | 7500 | 11431 |
| 3567 | 99-6001-372 | T | G | A | 7501 | 11432 |
| 3568 | 99-6020-477 | A | G | A | 7502 | 11433 |
| 3569 | 99-6047-225 | T | A | S | 7503 | 11434 |
| 3570 | 99-6071-272 | A | G | A | 7504 | 11435 |
| 3571 | 99-6076-394 | A | T | S | 7505 | 11436 |
| 3572 | 99-6096-354 | C | G | S | 7506 | 11437 |
| 3573 | 99-6103-356 | T | C | S | 7507 | 11438 |
| 3574 | 99-6124-125 | T | C | S | 7508 | 11439 |
| 3575 | 99-6173-229 | T | G | A | 7509 | 11440 |
| 3576 | 99-634-278 | T | A | A | 7510 | 11441 |
| 3577 | 99-6401-64 | A | G | A | 7511 | 11442 |
| 3578 | 99-6538-193 | G | A | A | 7512 | 11443 |
| 3579 | 99-6549-275 | A | G | A | 7513 | 11444 |
| 3580 | 99-6564-236 | G | C | S | 7514 | 11445 |
| 3581 | 99-6574-150 | T | G | A | 7515 | 11446 |
| 3582 | 99-6583-289 | A | G | A | 7516 | 11447 |
| 3583 | 99-6591-236 | T | C | S | 7517 | 11448 |
| 3584 | 99-6597-213 | A | G | A | 7518 | 11449 |
| 3585 | 99-6603-47 | A | G | A | 7519 | 11450 |
| 3586 | 99-6707-405 | G | A | A | 7520 | 11451 |
| 3587 | 99-6720-186 | C | G | S | 7521 | 11452 |
| 3588 | 99-6809-317 | C | T | S | 7522 | 11453 |
| 3589 | 99-6834-307 | G | A | A | 7523 | 11454 |
| 3590 | 99-6837-253 | C | A | S | 7524 | 11455 |
| 3591 | 99-6878-317 | C | T | S | 7525 | 11456 |
| 3592 | 99-6888-188 | T | G | A | 7526 | 11457 |
| 3593 | 99-6919-372 | G | A | A | 7527 | 11458 |
| 3594 | 99-6922-169 | T | C | S | 7528 | 11459 |
| 3595 | 99-6974-417 | A | G | A | 7529 | 11460 |
| 3596 | 99-6978-149 | C | G | S | 7530 | 11461 |
| 3597 | 99-6984-287 | G | C | S | 7531 | 11462 |
| 3598 | 99-6998-86 | T | C | S | 7532 | 11463 |
| 3599 | 99-7032-416 | T | A | S | 7533 | 11464 |
| 3600 | 99-7048-342 | C | T | S | 7534 | 11465 |
| 3601 | 99-7060-512 | A | G | A | 7535 | 11466 |
| 3602 | 99-7086-91 | G | C | S | 7536 | 11467 |
| 3603 | 99-7117-266 | T | A | S | 7537 | 11468 |
| 3604 | 99-7203-286 | T | C | A | 7538 | 11469 |
| 3605 | 99-7268-383 | T | C | S | 7539 | 11470 |
| 3606 | 99-7281-131 | T | C | A | 7540 | 11471 |
| 3607 | 99-7282-145 | G | T | A | 7541 | 11472 |
| 3608 | 99-7296-429 | T | C | A | 7542 | 11473 |
| 3609 | 99-7344-203 | C | T | S | 7543 | 11474 |
| 3610 | 99-7377-370 | T | C | S | 7544 | 11475 |
| 3611 | 99-7394-398 | A | G | A | 7545 | 11476 |
| 3612 | 99-7412-288 | C | T | S | 7546 | 11477 |
| 3613 | 99-7422-375 | C | T | S | 7547 | 11478 |
| 3614 | 99-7430-548 | T | A | S | 7548 | 11479 |
| 3615 | 99-7442-390 | T | C | S | 7549 | 11480 |
| 3616 | 99-7481-268 | A | G | A | 7550 | 11481 |
| 3617 | 99-7696-215 | C | T | S | 7551 | 11482 |
| 3618 | 99-7702-225 | C | T | S | 7552 | 11483 |
| 3619 | 99-7772-185 | C | T | S | 7553 | 11484 |
| 3620 | 99-7815-70 | A | T | S | 7554 | 11485 |
| 3621 | 99-7818-342 | G | A | A | 7555 | 11486 |
| 3622 | 99-7860-320 | T | G | A | 7556 | 11487 |
| 3623 | 99-7886-350 | G | C | S | 7557 | 11488 |
| 3624 | 99-7944-130 | A | T | S | 7558 | 11489 |
| 3625 | 99-7945-106 | G | A | A | 7559 | 11490 |
| 3626 | 99-7976-324 | A | G | A | 7560 | 11491 |
| 3627 | 99-8000-88 | C | T | S | 7561 | 11492 |
| 3628 | 99-8006-241 | C | T | S | 7562 | 11493 |
| 3629 | 99-8038-47 | T | C | S | 7563 | 11494 |
| 3630 | 99-8055-299 | A | G | A | 7564 | 11495 |
| 3631 | 99-8059-59 | A | G | A | 7565 | 11496 |
| 3632 | 99-8061-106 | C | T | S | 7566 | 11497 |
| 3633 | 99-8109-168 | A | G | A | 7567 | 11498 |
| 3634 | 99-8115-238 | T | G | A | 7568 | 11499 |
| 3635 | 99-8166-370 | T | C | S | 7569 | 11500 |
| 3636 | 99-8226-78 | T | G | A | 7570 | 11501 |
| 3637 | 99-8232-303 | A | G | A | 7571 | 11502 |
| 3638 | 99-824-359 | C | T | S | 7572 | 11503 |
| 3639 | 99-8274-70 | A | G | A | 7573 | 11504 |
| 3640 | 99-8359-153 | T | A | S | 7574 | 11505 |
| 3641 | 99-8630-298 | G | A | A | 7575 | 11506 |
| 3642 | 99-8659-399 | T | A | S | 7576 | 11507 |
| 3643 | 99-8679-371 | T | G | A | 7577 | 11508 |
| 3644 | 99-8690-117 | T | C | S | 7578 | 11509 |
| 3645 | 99-8751-299 | C | T | S | 7579 | 11510 |
| 3646 | 99-8795-58 | G | A | A | 7580 | 11511 |
| 3647 | 99-882-250 | C | A | S | 7581 | 11512 |
| 3648 | 99-887-344 | G | T | A | 7582 | 11513 |
| 3649 | 99-8875-283 | G | A | A | 7583 | 11514 |
| 3650 | 99-892-77 | T | C | S | 7584 | 11515 |
| 3651 | 99-8936-202 | T | C | S | 7585 | 11516 |
| 3652 | 99-8952-319 | G | C | S | 7586 | 11517 |
| 3653 | 99-896-83 | T | C | S | 7587 | 11518 |
| 3654 | 99-899-252 | G | C | S | 7588 | 11519 |
| 3655 | 99-9072-32 | G | C | S | 7589 | 11520 |
| 3656 | 99-9076-357 | C | T | S | 7590 | 11521 |
| 3657 | 99-9077-52 | T | C | S | 7591 | 11522 |
| 3658 | 99-9089-155 | T | A | S | 7592 | 11523 |
| 3659 | 99-9113-277 | C | A | S | 7593 | 11524 |
| 3660 | 99-9145-438 | A | G | A | 7594 | 11525 |
| 3661 | 99-9164-365 | T | C | S | 7595 | 11526 |
| 3662 | 99-9308-416 | A | G | A | 7596 | 11527 |
| 3663 | 99-9316-399 | A | G | A | 7597 | 11528 |
| 3664 | 99-9343-71 | C | T | S | 7598 | 11529 |
| 3665 | 99-9362-282 | T | C | S | 7599 | 11530 |
| 3666 | 99-9363-143 | G | A | A | 7600 | 11531 |
| 3667 | 99-9375-337 | G | C | S | 7601 | 11532 |
| 3668 | 99-9380-292 | T | C | S | 7602 | 11533 |
| 3669 | 99-9607-402 | C | T | A | 7603 | 11534 |
| 3670 | 99-9620-241 | C | T | S | 7604 | 11535 |
| 3671 | 99-9623-330 | T | C | S | 7605 | 11536 |
| 3672 | 99-9633-32 | T | C | S | 7606 | 11537 |
| 3673 | 99-9636-423 | T | C | S | 7607 | 11538 |
| 3674 | 99-9658-42 | T | G | A | 7608 | 11539 |
| 3675 | 99-9662-213 | T | C | A | 7609 | 11540 |
| 3676 | 99-9666-363 | T | C | A | 7610 | 11541 |
| 3677 | 99-9668-185 | C | T | A | 7611 | 11542 |
| 3678 | 99-9680-363 | A | G | S | 7612 | 11543 |
| 3679 | 99-9696-292 | T | C | A | 7613 | 11544 |
| 3680 | 99-9697-375 | A | C | S | 7614 | 11545 |
| 3681 | 99-9700-289 | C | T | A | 7615 | 11546 |
| 3682 | 99-9704-445 | T | C | A | 7616 | 11547 |
| 3683 | 99-9706-448 | C | T | A | 7617 | 11548 |
| 3684 | 99-9709-115 | T | C | A | 7618 | 11549 |
| 3685 | 99-9710-242 | C | A | S | 7619 | 11550 |

TABLE 1-continued

| SEQ ID No. | Marker Name | Allele 1ST | Allele 2ND | Preferred microseq. primer | Amplification primer Upstream (PU) | Amplification primer Downstream (RP) |
|---|---|---|---|---|---|---|
| 3686 | 99-9714-302 | T | C | S | 7620 | 11551 |
| 3687 | 99-9717-449 | A | G | A | 7621 | 11552 |
| 3688 | 99-9726-190 | T | C | S | 7622 | 11553 |
| 3689 | 99-974-231 | A | G | A | 7623 | 11554 |
| 3690 | 99-9745-284 | G | A | A | 7624 | 11555 |
| 3691 | 99-9751-134 | A | T | S | 7625 | 11556 |
| 3692 | 99-9765-237 | A | G | S | 7626 | 11557 |
| 3693 | 99-9774-392 | A | T | S | 7627 | 11558 |
| 3694 | 99-9778-360 | A | G | S | 7628 | 11559 |
| 3695 | 99-9781-174 | T | C | A | 7629 | 11560 |
| 3696 | 99-9785-141 | T | C | A | 7630 | 11561 |
| 3697 | 99-9810-257 | A | T | S | 7631 | 11562 |
| 3698 | 99-9811-369 | C | T | A | 7632 | 11563 |
| 3699 | 99-9820-483 | C | T | A | 7633 | 11564 |
| 3700 | 99-9822-257 | A | T | S | 7634 | 11565 |
| 3701 | 99-9829-367 | G | A | S | 7635 | 11566 |
| 3702 | 99-983-278 | G | A | A | 7636 | 11567 |
| 3703 | 99-9832-128 | T | C | A | 7637 | 11568 |
| 3704 | 99-9833-167 | A | G | S | 7638 | 11569 |
| 3705 | 99-9835-217 | C | T | A | 7639 | 11570 |
| 3706 | 99-9837-275 | A | G | S | 7640 | 11571 |
| 3707 | 99-9839-416 | G | C | S | 7641 | 11572 |
| 3708 | 99-9840-192 | C | T | A | 7642 | 11573 |
| 3709 | 99-9847-25 | A | G | S | 7643 | 11574 |
| 3710 | 99-9849-291 | G | A | S | 7644 | 11575 |
| 3711 | 99-9852-276 | T | C | A | 7645 | 11576 |
| 3712 | 99-9854-316 | G | C | S | 7646 | 11577 |
| 3713 | 99-9856-252 | C | T | A | 7647 | 11578 |
| 3714 | 99-9859-132 | C | A | S | 7648 | 11579 |
| 3715 | 99-9866-365 | T | C | A | 7649 | 11580 |
| 3716 | 99-990-356 | T | A | S | 7650 | 11581 |
| 3717 | 99-9906-280 | G | C | S | 7651 | 11582 |
| 3718 | 99-9908-423 | T | A | S | 7652 | 11583 |
| 3719 | 99-991-157 | A | G | A | 7653 | 11584 |
| 3720 | 99-9915-281 | T | G | A | 7654 | 11585 |
| 3721 | 99-9920-245 | T | C | A | 7655 | 11586 |
| 3722 | 99-9921-365 | T | C | A | 7656 | 11587 |
| 3723 | 99-9922-154 | C | T | A | 7657 | 11588 |
| 3724 | 99-9926-454 | G | A | S | 7658 | 11589 |
| 3725 | 99-9928-454 | C | T | A | 7659 | 11590 |
| 3726 | 99-9929-144 | G | A | S | 7660 | 11591 |
| 3727 | 99-9935-418 | G | A | S | 7661 | 11592 |
| 3728 | 99-9941-426 | T | A | S | 7662 | 11593 |
| 3729 | 99-995-251 | A | C | S | 7663 | 11594 |
| 3730 | 99-996-210 | T | C | S | 7664 | 11595 |
| 3731 | 99-9986-202 | T | C | S | 7665 | 11596 |
| 3732 | 99-9988-111 | T | G | A | 7666 | 11597 |
| 3733 | 99-9994-226 | C | A | S | 7667 | 11598 |
| 3734 | 99-9995-50 | C | T | S | 7668 | 11599 |
| 3735 | 99-10069-366 | A | T | S | 7669 | 11600 |
| 3736 | 99-10074-266 | A | G | A | 7670 | 11601 |
| 3737 | 99-10129-177 | A | G | S | 7671 | 11602 |
| 3738 | 99-10198-271 | A | G | S | 7672 | 11603 |
| 3739 | 99-10306-345 | C | T | A | 7673 | 11604 |
| 3740 | 99-10307-115 | A | G | S | 7674 | 11605 |
| 3741 | 99-10326-149 | C | T | A | 7675 | 11606 |
| 3742 | 99-10393-179 | A | G | S | 7676 | 11607 |
| 3743 | 99-10685-454 | A | C | S | 7677 | 11608 |
| 3744 | 99-10857-217 | C | T | A | 7678 | 11609 |
| 3745 | 99-10948-281 | C | T | A | 7679 | 11610 |
| 3746 | 99-11104-329 | A | G | S | 7680 | 11611 |
| 3747 | 99-11116-199 | C | T | A | 7681 | 11612 |
| 3748 | 99-11117-282 | A | G | S | 7682 | 11613 |
| 3749 | 99-11121-461 | A | G | S | 7683 | 11614 |
| 3750 | 99-11124-363 | C | T | A | 7684 | 11615 |
| 3751 | 99-11172-373 | C | T | A | 7685 | 11616 |
| 3752 | 99-11206-379 | C | T | A | 7686 | 11617 |
| 3753 | 99-11303-223 | C | T | A | 7687 | 11618 |
| 3754 | 99-11307-168 | G | T | A | 7688 | 11619 |
| 3755 | 99-11325-188 | A | G | S | 7689 | 11620 |
| 3756 | 99-11365-273 | C | T | A | 7690 | 11621 |
| 3757 | 99-11389-268 | A | T | S | 7691 | 11622 |
| 3758 | 99-11395-376 | A | G | S | 7692 | 11623 |
| 3759 | 99-11500-50 | C | T | S | 7693 | 11624 |
| 3760 | 99-11571-88 | G | T | S | 7694 | 11625 |
| 3761 | 99-11710-452 | A | G | S | 7695 | 11626 |
| 3762 | 99-1173-208 | A | T | S | 7696 | 11627 |
| 3763 | 99-11735-215 | C | T | A | 7697 | 11628 |
| 3764 | 99-11864-218 | A | C | S | 7698 | 11629 |
| 3765 | 99-1187-293 | G | C | S | 7699 | 11630 |
| 3766 | 99-11872-228 | C | T | A | 7700 | 11631 |
| 3767 | 99-11878-212 | C | T | A | 7701 | 11632 |
| 3768 | 99-11905-202 | G | C | S | 7702 | 11633 |
| 3769 | 99-11932-48 | C | T | A | 7703 | 11634 |
| 3770 | 99-11964-158 | A | C | S | 7704 | 11635 |
| 3771 | 99-12164-412 | C | T | A | 7705 | 11636 |
| 3772 | 99-12227-278 | G | C | S | 7706 | 11637 |
| 3773 | 99-12417-447 | A | G | S | 7707 | 11638 |
| 3774 | 99-12459-119 | G | T | A | 7708 | 11639 |
| 3775 | 99-12521-212 | C | T | S | 7709 | 11640 |
| 3776 | 99-12569-95 | A | G | A | 7710 | 11641 |
| 3777 | 99-1298-430 | A | G | S | 7711 | 11642 |
| 3778 | 99-1315-105 | G | C | S | 7712 | 11643 |
| 3779 | 99-13154-74 | C | T | A | 7713 | 11644 |
| 3780 | 99-13155-134 | A | G | S | 7714 | 11645 |
| 3781 | 99-13249-461 | C | T | A | 7715 | 11646 |
| 3782 | 99-13794-147 | G | C | S | 7716 | 11647 |
| 3783 | 99-14899-215 | A | C | S | 7717 | 11648 |
| 3784 | 99-16351-44 | C | T | A | 7718 | 11649 |
| 3785 | 99-16436-382 | A | G | S | 7719 | 11650 |
| 3786 | 99-16753-387 | G | C | S | 7720 | 11651 |
| 3787 | 99-1807-300 | A | G | A | 7721 | 11652 |
| 3788 | 99-19032-132 | A | C | S | 7722 | 11653 |
| 3789 | 99-19212-369 | C | T | S | 7723 | 11654 |
| 3790 | 99-19273-219 | A | G | A | 7724 | 11655 |
| 3791 | 99-19279-356 | C | T | S | 7725 | 11656 |
| 3792 | 99-19541-172 | A | G | A | 7726 | 11657 |
| 3793 | 99-19552-214 | G | T | A | 7727 | 11658 |
| 3794 | 99-21051-435 | C | T | S | 7728 | 11659 |
| 3795 | 99-21246-20 | C | T | S | 7729 | 11660 |
| 3796 | 99-21387-465 | C | T | S | 7730 | 11661 |
| 3797 | 99-21407-352 | A | G | A | 7731 | 11662 |
| 3798 | 99-21418-83 | C | T | S | 7732 | 11663 |
| 3799 | 99-21419-85 | C | T | S | 7733 | 11664 |
| 3800 | 99-21430-308 | C | T | S | 7734 | 11665 |
| 3801 | 99-21435-96 | A | G | A | 7735 | 11666 |
| 3802 | 99-21446-240 | C | T | S | 7736 | 11667 |
| 3803 | 99-21452-173 | A | G | A | 7737 | 11668 |
| 3804 | 99-21488-376 | G | T | A | 7738 | 11669 |
| 3805 | 99-21489-227 | C | T | S | 7739 | 11670 |
| 3806 | 99-21496-248 | C | T | S | 7740 | 11671 |
| 3807 | 99-21519-446 | A | G | A | 7741 | 11672 |
| 3808 | 99-21618-178 | A | G | A | 7742 | 11673 |
| 3809 | 99-21725-371 | C | T | S | 7743 | 11674 |
| 3810 | 99-21773-155 | A | C | S | 7744 | 11675 |
| 3811 | 99-21781-252 | A | G | A | 7745 | 11676 |
| 3812 | 99-21820-230 | A | G | A | 7746 | 11677 |
| 3813 | 99-21822-50 | A | G | A | 7747 | 11678 |
| 3814 | 99-21939-170 | A | T | S | 7748 | 11679 |
| 3815 | 99-22404-59 | A | G | A | 7749 | 11680 |
| 3816 | 99-22594-395 | A | G | A | 7750 | 11681 |
| 3817 | 99-22679-148 | A | C | S | 7751 | 11682 |
| 3818 | 99-23095-184 | G | C | S | 7752 | 11683 |
| 3819 | 99-23370-249 | C | T | S | 7753 | 11684 |
| 3820 | 99-23568-395 | G | C | S | 7754 | 11685 |
| 3821 | 99-23824-339 | C | T | S | 7755 | 11686 |
| 3822 | 99-23969-316 | C | T | A | 7756 | 11687 |
| 3823 | 99-24032-138 | A | T | S | 7757 | 11688 |
| 3824 | 99-24048-286 | C | T | S | 7758 | 11689 |
| 3825 | 99-24074-190 | A | G | A | 7759 | 11690 |
| 3826 | 99-24082-408 | A | C | S | 7760 | 11691 |
| 3827 | 99-24104-308 | G | T | A | 7761 | 11692 |
| 3828 | 99-24138-224 | A | G | A | 7762 | 11693 |
| 3829 | 99-24172-116 | C | T | S | 7763 | 11694 |
| 3830 | 99-24267-190 | A | C | S | 7764 | 11695 |
| 3831 | 99-24949-289 | C | T | A | 7765 | 11696 |

TABLE 1-continued

| SEQ ID No. | Marker Name | Allele 1ST | Allele 2ND | Preferred microseq. primer | Amplification primer Upstream (PU) | Amplification primer Downstream (RP) |
|---|---|---|---|---|---|---|
| 3832 | 99-253-97 | A | G | A | 7766 | 11697 |
| 3833 | 99-2694-411 | A | G | A | 7767 | 11698 |
| 3834 | 99-2697-336 | A | G | A | 7768 | 11699 |
| 3835 | 99-2720-280 | A | G | A | 7769 | 11700 |
| 3836 | 99-2851-105 | G | C | S | 7770 | 11701 |
| 3837 | 99-2889-197 | C | T | S | 7771 | 11702 |
| 3838 | 99-3072-323 | A | G | A | 7772 | 11703 |
| 3839 | 99-3089-49 | A | G | A | 7773 | 11704 |
| 3840 | 99-3157-203 | G | T | A | 7774 | 11705 |
| 3841 | 99-3210-341 | G | T | A | 7775 | 11706 |
| 3842 | 99-3218-344 | A | G | A | 7776 | 11707 |
| 3843 | 99-3251-254 | G | T | A | 7777 | 11708 |
| 3844 | 99-3298-158 | C | T | A | 7778 | 11709 |
| 3845 | 99-3300-433 | A | G | A | 7779 | 11710 |
| 3846 | 99-3364-247 | A | T | S | 7780 | 11711 |
| 3847 | 99-3427-271 | A | G | A | 7781 | 11712 |
| 3848 | 99-3484-96 | A | G | A | 7782 | 11713 |
| 3849 | 99-3537-196 | A | G | A | 7783 | 11714 |
| 3850 | 99-3568-156 | G | T | A | 7784 | 11715 |
| 3851 | 99-3592-325 | A | G | A | 7785 | 11716 |
| 3852 | 99-3602-245 | C | T | S | 7786 | 11717 |
| 3853 | 99-3608-264 | A | G | A | 7787 | 11718 |
| 3854 | 99-3643-352 | A | G | A | 7788 | 11719 |
| 3855 | 99-3770-363 | C | T | S | 7789 | 11720 |
| 3856 | 99-3772-266 | A | G | A | 7790 | 11721 |
| 3857 | 99-3790-361 | A | G | A | 7791 | 11722 |
| 3858 | 99-3818-255 | A | G | A | 7792 | 11723 |
| 3859 | 99-3863-328 | A | G | A | 7793 | 11724 |
| 3860 | 99-3879-245 | A | G | A | 7794 | 11725 |
| 3861 | 99-3882-312 | C | T | S | 7795 | 11726 |
| 3862 | 99-3883-329 | C | T | S | 7796 | 11727 |
| 3863 | 99-3884-355 | G | C | S | 7797 | 11728 |
| 3864 | 99-3894-333 | C | T | S | 7798 | 11729 |
| 3865 | 99-3936-352 | A | G | S | 7799 | 11730 |
| 3866 | 99-3946-236 | A | G | A | 7800 | 11731 |
| 3867 | 99-4029-174 | C | T | S | 7801 | 11732 |
| 3868 | 99-4036-308 | C | T | S | 7802 | 11733 |
| 3869 | 99-4102-109 | A | G | A | 7803 | 11734 |
| 3870 | 99-4110-180 | A | G | A | 7804 | 11735 |
| 3871 | 99-4111-259 | A | G | A | 7805 | 11736 |
| 3872 | 99-4126-366 | A | G | A | 7806 | 11737 |
| 3873 | 99-4157-72 | A | G | A | 7807 | 11738 |
| 3874 | 99-4228-168 | C | T | S | 7808 | 11739 |
| 3875 | 99-4239-328 | A | G | A | 7809 | 11740 |
| 3876 | 99-4254-307 | A | G | A | 7810 | 11741 |
| 3877 | 99-4264-228 | C | T | S | 7811 | 11742 |
| 3878 | 99-4311-146 | A | G | A | 7812 | 11743 |
| 3879 | 99-4381-385 | C | T | S | 7813 | 11744 |
| 3880 | 99-4403-194 | A | C | S | 7814 | 11745 |
| 3881 | 99-4524-296 | A | G | A | 7815 | 11746 |
| 3882 | 99-4582-359 | G | T | A | 7816 | 11747 |
| 3883 | 99-4611-151 | C | T | S | 7817 | 11748 |
| 3884 | 99-4689-375 | A | T | S | 7818 | 11749 |
| 3885 | 994762-114 | A | G | A | 7819 | 11750 |
| 3886 | 99-4878-107 | C | T | S | 7820 | 11751 |
| 3887 | 99-5075-219 | C | T | A | 7821 | 11752 |
| 3888 | 99-5190-277 | A | G | A | 7822 | 11753 |
| 3889 | 99-5605-90 | G | T | A | 7823 | 11754 |
| 3890 | 99-5882-105 | C | T | S | 7824 | 11755 |
| 3891 | 99-5977-241 | C | T | S | 7825 | 11756 |
| 3892 | 99-5993-323 | C | T | S | 7826 | 11757 |
| 3893 | 99-5994-205 | G | T | S | 7827 | 11758 |
| 3894 | 99-6827-399 | A | G | A | 7828 | 11759 |
| 3895 | 99-7076-198 | C | T | S | 7829 | 11760 |
| 3896 | 99-7215-279 | C | T | S | 7830 | 11761 |
| 3897 | 99-8206-133 | A | G | A | 7831 | 11762 |
| 3898 | 99-8614-236 | A | G | A | 7832 | 11763 |
| 3899 | 99-889-153 | G | C | S | 7833 | 11764 |
| 3900 | 99-9450-70 | A | T | S | 7834 | 11765 |
| 3901 | 99-9609-220 | C | T | A | 7835 | 11766 |
| 3902 | 99-9612-324 | A | G | S | 7836 | 11767 |
| 3903 | 99-9616-136 | A | G | A | 7837 | 11768 |
| 3904 | 99-9683-49 | A | G | S | 7838 | 11769 |
| 3905 | 99-9907-88 | C | T | A | 7839 | 11770 |
| 3906 | 99-993-218 | C | T | S | 7840 | 11771 |
| 3907 | 99-24069-351 | C | T | S | 7841 | 11772 |
| 3908 | 99-3855-279 | G | C | A | 7842 | 11773 |
| 3909 | 99-344-439 | G | A | A | 7843 | 11774 |
| 3910 | 99-366-274 | C | T | S | 7844 | 11775 |
| 3911 | 99-359-308 | A | G | A | 7845 | 11776 |
| 3912 | 99-355-219 | A | G | A | 7846 | 11777 |
| 3913 | 99-365-344 | C | T | S | 7847 | 11778 |
| 3914 | 99-2452-54 | C | T | S | 7848 | 11779 |
| 3915 | 99-123-381 | C | T | S | 7849 | 11780 |
| 3916 | 4-26-29 | A | G | A | 7850 | 11781 |
| 3917 | 4-14-240 | C | T | S | 7851 | 11782 |
| 3918 | 4-77-151 | G | C | S | 7852 | 11783 |
| 3919 | 99-217-277 | C | T | S | 7853 | 11784 |
| 3920 | 4-67-40 | C | T | S | 7854 | 11785 |
| 3921 | 99-213-164 | A | G | A | 7855 | 11786 |
| 3922 | 99-221-377 | A | C | S | 7856 | 11787 |
| 3923 | 99-135-196 | A | G | A | 7857 | 11788 |
| 3924 | 99-1482-32 | A | C | S | 7858 | 11789 |
| 3925 | 4-73-134 | G | C | S | 7859 | 11790 |
| 3926 | 4-65-324 | C | T | S | 7860 | 11791 |
| 3927 | 10-32-357 | A | C | S | 7861 | 11792 |
| 3928 | 10-33-175 | T | C | S | 7862 | 11793 |
| 3929 | 10-33-234 | A | C | S | 7862 | 11793 |
| 3930 | 10-33-327 | C | T | S | 7862 | 11793 |
| 3931 | 10-35-358 | G | C | A | 7863 | 11794 |
| 3932 | 10-35-390 | T | C | S | 7863 | 11794 |
| 3933 | 10-36-164 | A | G | A | 7864 | 11795 |
| 3934 | 10-204-326 | A | G | A | 7865 | 11796 |

TABLE 9

| SEQ ID No. | Marker Name | Chromosomal Localization | Adjacent STS (including aliases) |
|---|---|---|---|
| 2 | 9-1126-384 | 10p12.1–p11.2 | g12982/WI-15761/EST230735/RH51226/R45505 |
|  |  |  | g26880/SRGC-2047/Z24310 |
|  |  |  | g26882/SHGC-14408 |
|  |  |  | g4194/AFMa109xe1/D10S1641/ |
| 9 | 9-1217-332 | 21q11.2–q21 | g7903/D21S1880/ |
| 59 | 9-1263-276 | 21q21 | g7833/D21S177 |
|  |  |  | g7957/D21S409/ |

TABLE 9-continued

| SEQ ID No. | Marker Name | Chromosomal Localization | Adjacent STS (including aliases) |
|---|---|---|---|
| 236 | 9-1367-287 | 1q43 | g401/D1S2483/G04024<br>g428/EST386335/RH50010/SGC35175/ |
| 238 | 9-13678-251 | 1q43 | g15623/D1S547/GATA4A09<br>g17350/RH1290/SHGC-477<br>g17708/RH11033/D29436/D29436<br>g18500/RH26479/R65593<br>g319/EST161941/RH50228/RH64454/SGC33718/T91820<br>g405/D1S1707/G02394<br>g408/AFM214xe11/Z66804<br>g417/D1S2421/WI-9317/D29955/RH49709<br>g420/WI-15754/RH49799<br>g426/WI-13731/RH49867/RH64343/R44970/ |
| 239 | 9-13679-285 | 1q43 | g15623/D1S547/GATA4A09<br>g17350/RH1290/SHGC-477<br>g17708/RH11033/D29436/D29436<br>g18500/RH26479/R65593<br>g319/EST161941/RH50228/RH64454/SGC33718/T91820<br>g405/D1S1707/G02394<br>g408/AFM214xe11/Z66804<br>g417/D1S2421/WI-9317/D29955/RH49709<br>g420/WI-15754/RH49799<br>g426/WI-13731/RH49867/RH64343/R44970/ |
| 240 | 9-1368-299 | 1q43 | g401/D1S2483/G04024<br>g428/EST386335/RH50010/SGC35175/ |
| 241 | 9-13684-488 | 1q43 | g15623/D1S547/GATA4A09<br>g17350/RH1290/SHGC-477<br>g17708/RH11033/D29436/D29436<br>g18500/RH26479/R65593<br>g319/EST161941/RH50228/RH64454/SGC33718/T91820<br>g405/D1S1707/G02394<br>g408/AFM214xe11/Z66804<br>g417/D1S2421/WI-9317/D29955/RH49709<br>g420/WI-15754/RH49799<br>g426/WI-13731/RH49867/RH64343/R44970/ |
| 242 | 9-13687-316 | 1q43 | g15623/D1S547/GATA4A09<br>g17350/RH1290/SHGC-477<br>g17708/RH11033/D29436/D29436<br>g18500/RH26479/R65593<br>g319/EST161941/RH50228/RH64454/SGC33718/T91820<br>g405/D1S1707/G02394<br>g408/AFM214xe11/Z66804<br>g417/D1S2421/WI-9317/D29955/RH49709<br>g420/WI-15754/RH49799<br>g426/WI-13731/RH49867/RH64343/R44970 |
| 243 | 9-1373-358 | 1q43 | g401/D1S2483/G04024<br>g428/EST386335/RH50010/SGC35175/ |
| 244 | 9-1376-196 | 1q43 | g401/D1S2483/G04024<br>g428/EST386335/RH50010/SGC35175/ |
| 245 | 9-13790-129 | 1q43 | g1262/AFM088xe5/D1S2850<br>g17846/RH12368/stSG3536<br>g18893/RH34172/L18266/SHGC-4752<br>g307/WI-11654/RH50099/RH63795/R10130<br>g317/EST382595/RR49984/SGC34592<br>g402/D1S1680/G09467<br>g421/WI-12850/RH50542/Z41492<br>g4882/AFMa245wd5/D1S2678<br>g4901/AFMa247wg9/D1S2680/ |
| 246 | 9-13798-284 | 1q43 | g1262/AFM088xe5/D1S2850<br>g17846/RH12368/stSG3536<br>g18893/RH34172/L18266/SHGC-4752<br>g307/WI-11654/RH50099/RH63795/R10130<br>g317/EST382595/RH49984/SGC34592<br>g402/D1S1680/G09467<br>g421/WI-12850/RH50542/Z41492<br>g4882/AFMa245wd5/D1S2678<br>g4901/AFMa247wg9/D1S2680/ |
| 250 | 9-1385-91 | 1q43 | g313/D1S3401/G04332<br>g404/D1S3450/G11836/ |
| 257 | 9-1387-462 | 1q43 | g313/D1S3401/G04332<br>g404/D1S3450/G11836/ |
| 260 | 9-1388-242 | 1q43 | g313/D1S3401/G04332<br>g404/D1S3450/G11836/ |
| 267 | 9-1391-204 | 1q43 | g313/D1S3401/G04332<br>g404/D1S3450/G11836/ |
| 271 | 9-1392-200 | 1q43 | g313/D1S3401/G04332<br>g404/D1S3450/G11836/ |

TABLE 9-continued

| SEQ ID No. | Marker Name | Chromosomal Localization | Adjacent STS (including aliases) |
|---|---|---|---|
| 276 | 9-1394-271 | 1q43 | g313/D1S3401/G04332<br>g404/D1S3450/G11836/ |
| 304 | 9-1413-137 | 1q43;5q34 | g410/D1S180/ |
| 311 | 9-1416-589 | 1q43;5q34 | g410/D1S180/ |
| 328 | 9-14277-73 | 1q43 | g416/D1S3481/G13394/ |
| 329 | 9-14282-334 | 1q43 | g416/D1S3481/G13394/ |
| 330 | 9-14285-381 | 1q43 | g416/D1S3481/G13394/ |
| 331 | 9-14286-220 | 1q43 | g416/D1S3481/G13394/ |
| 332 | 9-14309-259 | 2q35 | g1392/AFM119xc7/D2S126<br>g4167/AFMa104yd5/D2S2148/ |
| 333 | 9-14315-405 | 2q35 | g1392/AFM119xc7/D2S126<br>g4167/AFMa104yd5/D2S2148/ |
| 334 | 9-14329-205 | 2q35 | g1392/AFM119xc7/D2S126<br>g4167/AFMa104yd5/D2S2148/ |
| 335 | 9-14331-64 | 2q35 | g1392/AFM119xc7/D2S126<br>g4167/AFMa104yd5/D2S2148/ |
| 336 | 9-14332-437 | 2q35 | g1392/AFM119xc7/D2S126<br>g4167/AFMa104yd5/D2S2148/ |
| 340 | 9-1437-325 | 1q43 | g18377/RH25341/D29955<br>g425/WI-12765/RH50388/RH63951/Z39518/ |
| 346 | 9-1442-224 | 1q43 | g18377/RH25341/D29955<br>g425/WI-12765/RH50388/RH63951/Z39518/ |
| 351 | 9-14468-247 | 2q32 | g650/RH18030/RH70596/ |
| 352 | 9-14470-243 | 2q32 | g650/RH18030/RH70596/ |
| 353 | 9-14492-322 | 2q33 | g1453/AFM135xf12/D2S2396/ |
| 354 | 9-14497-220 | 2q33 | g1453/AFM135xf12/D2S2396/ |
| 355 | 9-14505-250 | 5q31.3 | g2885/AFM282wd5/D5S638/ |
| 356 | 9-14518-57 | 11p15.5–p15.4 | g6052/AFMb355za9/D11S4177/ |
| 357 | 9-1453-204 | 4p14 | g3928/AFMa061zh9/D4S3040/ |
| 381 | 9-1462-238 | 8p23.2–p23.1 | g480/WI-9756/G05400/ |
| 409 | 9-1468-435 | 8p23.2–p23.1 | g480/WI-9756/G05400/ |
| 410 | 9-1469-47 | 8p23.2–p23.1 | g480/WI-9756/G05400/ |
| 418 | 9-1471-571 | 8p23.2–p23.1 | g480/WI-9756/G05400/ |
| 423 | 9-1472-435 | 8p23.2–p23.1 | g480/WI-9756/G05400/ |
| 428 | 9-1474-156 | 8p23.2–p23.1 | g480/WI-9756/G05400/ |
| 432 | 9-1476-172 | 8p23.2–p23.1 | g480/WI-9756/G05400/ |
| 494 | 9-14950-346 | 5q31.1–q31.2 | g1446/AFM127xh4/D5S402/ |
| 495 | 9-14959-81 | 1q43 | g423/WI-18277/RH49873<br>g424/WI-11392/RH49759/RH63907/T87504/ |
| 496 | 9-14961-193 | 1q43 | g423/WI-18277/RH49873<br>g424/WI-11392/RH49759/RH63907/T87504/ |
| 497 | 9-14962-120 | 1q43 | g423/WI-18277/RH49873<br>g424/WI-11392/RH49759/RR63907/T87504/ |
| 498 | 9-14966-187 | 1q43 | g423/WI-18277/RH49873<br>g424/WI-11392/RH49759/RH63907/T87504/ |
| 499 | 9-14970-352 | 2q33 | g3108/AFM297ve9/D252336<br>g648/EST180027/RH56357/SGC34048/R09731/ |
| 500 | 9-14978-200 | 2q33 | g3108/AFM297ve9/D2S2336<br>g648/EST180027/RH56357/SGC34048/R09731/ |
| 502 | 9-14983-186 | 2q33 | g3108/AFM297ve9/D2S2336<br>g648/EST180027/RH56357/SGC34048/R09731/ |
| 503 | 9-14984-35 | 2q33 | g3108/AFM297ve9/D252336<br>g648/EST180027/RH56357/SGC34048/R09731/ |
| 504 | 9-15005-169 | 1q42.3–q43 | g427/AFMa111yd5/Z67285/ |
| 505 | 9-15007-369 | 1q42.3–q43 | g427/AFMa111yd5/Z67285/ |
| 507 | 9-15016-293 | 2p24 | g2364/AFM234vg5/D25309/ |
| 508 | 9-15018-270 | 2p24 | g2364/AFM234vg5/D25309/ |
| 509 | 9-15019-408 | 2p24 | g2364/AFM234vg5/D25309/ |
| 510 | 9-15021-189 | 2p24 | g2364/AFM234vg5/D25309/ |
| 511 | 9-15030-271 | 2q33.3–q34 | g24928/SHGC-1643/Z24076<br>g2972/AFM289vf5/D2S346/ |
| 512 | 9-15039-277 | 2q33.3–q34 | g24928/SHGC-1643/Z24076<br>g2972/AFM289vf5/D2S346/ |
| 514 | 9-15043-175 | 2q33.3–q34 | g24928/SHGC-1643/Z24076<br>g2972/AFM289vf5/D2S346/ |
| 515 | 9-15046-54 | 2q33.3–q34 | g24928/SHGC-1643/Z24076<br>g2972/AFM289vf5/D2S346/ |
| 543 | 9-15290-343 | 5q31.3 | g1094/AFM042xd12/D5S393/ |
| 544 | 9-15296-326 | 5q31.3 | g1094/AFM042xd12/D5S393/ |
| 545 | 9-15302-371 | 5q31.3 | g1094/AFM042xd12/D5S393/ |
| 546 | 9-15307-251 | 2q34–q35 | g1698/AFM172xg3/D2S137<br>g19419/RH56366/R00076/SGC33908/RH56366<br>g885/WI-17547/EST253706/R76848/ |
| 547 | 9-15310-385 | 2q34–q35 | g1698/AFM172xg3/D2S137<br>g19419/RH56366/R00076/SGC33908/RH56366<br>g885/WI-17547/EST253706/R76848/ |

TABLE 9-continued

| SEQ ID No. | Marker Name | Chromosomal Localization | Adjacent STS (including aliases) |
|---|---|---|---|
| 548 | 9-15325-95 | 2q34–q35 | g1698/AFM172xg3/D2S137<br>g19419/RH56366/R00076/SGC33908/RH56366<br>g885/WI-17547/EST253706/R76848/ |
| 549 | 9-15328-328 | 2q34–q35 | g1698/AFM172xg3/D2S137<br>g19419/RH56366/R00076/SGC33908/RH56366<br>g885/WI-17547/EST253706/R76848/ |
| 551 | 9-15330-301 | 2q34–q35 | g1698/AFM172xg3/D2S137<br>g19419/RH56366/R00076/SGC33908/RH56366<br>g885/WI-17547/EST253706/R76848/ |
| 552 | 9-15335-313 | 1q43 | g422/WI-15487/RH50392/RH64322/R39926<br>g431/WI-31075/RH50186/RH64283/SGC31075/ |
| 553 | 9-15339-378 | 1q43 | g422/WI-15487/RH50392/RH64322/R39926<br>g431/WI-31075/RH50186/RH64283/SGC31075/ |
| 554 | 9-15345-376 | 11p15.5–p15.4 | g6052/AFMb355za9/D11S4177/ |
| 570 | 9-1549-124 | 1q43 | g1385/AFM116xf8/D1S304<br>g407/AFM151XB8/Z66679/ |
| 584 | 9-1553-544 | 1q43 | g1385/AFM116xf8/D1S304<br>g407/AFM151XB8/Z66679/ |
| 588 | 9-1557-251 | 1q43 | g1385/AFM116xf8/D1S304<br>g407/AFM151XB8/Z66679/ |
| 591 | 9-1558-26 | 1q43 | g1385/AFM116xf8/D1S304<br>g407/AFM151XB8/Z66679/ |
| 597 | 9-15625-299 | 1q43 | g17455/AFMa045zc5<br>g309/WI-14972/RH50726/RH64224<br>g311/WI-14095/RH50061/RH64366/R55784<br>g403/WI-7199/RH49904/M30269<br>g406/AFM093XG5/Z66633/ |
| 598 | 9-15627-324 | 1q43 | g17455/AFMa045zc5<br>g309/WI-14972/RH50726/RH64224<br>g311/WI-14095/RH50061/RH64366/R55784<br>g403/WI-7199/RH49904/M30269<br>g406/AFM093XG5/Z66633/ |
| 599 | 9-15636-159 | 1q43 | g17455/AFMa045zc5<br>g309/WI-14972/RH50726/RH64224<br>g311/WI-14095/RH50061/RH64366/R55784<br>g403/WI-7199/RH49904/M30269<br>g406/AFM093XG5/Z66633/ |
| 600 | 9-15638-65 | Xp11.22–p11.21 | g4806/AFMa230vc1/DXS8032/ |
| 601 | 9-15648-83 | Xp11.22–p11.21 | g4806/AFMa230vc1/DXS8032/ |
| 602 | 9-15659-332 | Xp21.3–p21.2 | g3025/AFM292wb9/DXS1218/ |
| 603 | 9-1568-240 | 1q43 | g1385/AFM116xf8/D1S304<br>g407/AFM151XB8/Z66679/ |
| 607 | 9-1572-440 | 1q43 | g1262/AFM088xe5/D1S2850<br>g17846/RH12368/stSG3536<br>g18893/RH34172/L18266/SHGC-4752<br>g307/WI-11654/RH50099/RH63795/R10130<br>g317/EST382595/RH49984/SGC34592<br>g402/D1S1680/G09467<br>g421/WI-12850/RH50542/Z41492<br>g4882/AFMa245wd5/D1S2678<br>g4901/AFMa247wg9/D1S2680/ |
| 616 | 9-1577-105 | 1q43 | g1262/AFM088xe5/D1S2850<br>g17846/RH12368/stSG3536<br>g18893/RH34172/L18266/SHGC-4752<br>g307/WI-11654/RH50099/RH63795/R10130<br>g317/EST382595/RH49984/SGC34592<br>g402/D1S1680/G09467<br>g421/WI-12850/RH50542/Z41492<br>g4882/AFMa245wd5/D1S2678<br>g4901/AFMa247wg9/D1S2680/ |
| 619 | 9-1578-496 | 1q43 | g1262/AFM088xe5/D1S2850<br>g17846/RH12368/stSG3536<br>g18893/RH34172/L18266/SHGC-4752<br>g307/WI-11654/RH50099/RH63795/R10130<br>g317/EST382595/RH49984/SGC34592<br>g402/D1S1680/G09467<br>g421/WI-12850/RH50542/Z41492<br>g4882/AFMa245wd5/D1S2678<br>g4901/AFMa247wg9/D1S2680/ |

TABLE 9-continued

| SEQ ID No. | Marker Name | Chromosomal Localization | Adjacent STS (including aliases) |
|---|---|---|---|
| 623 | 9-1582-430 | 1q43 | g1262/AFM088xe5/D1S2850<br>g17846/RH12368/stSG3536<br>g18893/RH34172/L18266/SHGC-4752<br>g307/WI-11654/RH50099/RH63795/R10130<br>g317/EST382595/RH49984/SGC34592<br>g402/D1S1680/G09467<br>g421/WI-12850/RH50542/Z41492<br>g4882/AFMa245wd5/D1S2678<br>g4901/AFMa247wg9/D1S2680/ |
| 626 | 9-1585-373 | 1q43 | g1262/AFM088xe5/D1S2850<br>g17846/RH12368/stSG3536<br>g18893/RH34172/L18266/SHGC-4752<br>g307/WI-11654/RH50099/RH63795/R10130<br>g317/EST382595/RH49984/SGC34592<br>g402/D1S1680/G09467<br>g421/WI-12850/RH50542/Z41492<br>g4882/AFMa245wd5/D1S2678<br>g4901/AFMa247wg9/D1S2680/ |
| 627 | 9-1587-281 | 1q43 | g1262/AFM088xe5/D1S2850<br>g17846/RH12368/stSG3536<br>g18893/RH34172/L18266/SHGC-4752<br>g307/WI-11654/RH50099/RH63795/R10130<br>g317/EST382595/RH49984/SGC34592<br>g402/D1S1680/G09467<br>g421/WI-12850/RH50542/Z41492<br>g4882/AFMa245wd5/D1S2678<br>g4901/AFMa247wg9/D1S2680/ |
| 629 | 9-1590-116 | 16q13;2q21 | g12752/WI-15065/EST284024/RH54840<br>g15308/D16S2966/UTR-01731<br>g23548/RH54739/R50764/WI-14274/ |
| 630 | 9-15916-270 | 16q13;2q21 | g12752/WI-15065/EST284024/RH54840<br>g15308/D16S2966/UTR-01731<br>g23548/RH54739/R50764/WI-14274/ |
| 631 | 9-15925-331 | 16q13;2q21 | g12752/WI-15065/EST284024/RH54840<br>g15308/D16S2966/UTR-01731<br>g23548/RH54739/R50764/WI-14274/ |
| 632 | 9-15947-109 | 16q13;2q21 | g12752/WI-15065/EST284024/RH54840<br>g15308/D16S2966/UTR-01731<br>g23548/RH54739/R50764/WI-14274/ |
| 636 | 9-1597-162 | 1q43 | g1262/AFM088xe5/D1S2850<br>g17846/RH12368/stSG3536<br>g18893/RH34172/L18266/SHGC-4752<br>g307/WI-11654/RH50099/RH63795/R10130<br>g317/EST382595/RH49984/SGC34592<br>g402/D1S1680/G09467<br>g421/WI-12850/RH50542/Z41492<br>g4882/AFMa245wd5/D1S2678<br>g4901/AFMa247wg9/D1S2680/ |
| 645 | 9-1601-402 | 1q43 | g1262/AFM088xe5/D1S2850<br>g17846/RH12368/stSG3536<br>g18893/RH34172/L18266/SHGC-4752<br>g307/WI-11654/RH50099/RH63795/R10130<br>g317/EST382595/RH49984/SGC34592<br>g402/D1S1680/G09467<br>g421/WI-12850/RH50542/Z41492<br>g4882/AFMa24Swd5/D1S2678<br>g4901/AFMa247wg9/D1S2680/ |
| 646 | 9-1602-200 | 1q43 | g1262/AFM088xe5/D1S2850<br>g17846/RH12368/stSG3536<br>g18893/RH34172/L18266/SHGC-4752<br>g307/WI-11654/RH50099/RH63795/R10130<br>g317/EST382595/RH49984/SGC34592<br>g402/D1S1680/G09467<br>g421/WI-12850/RH50542/Z41492<br>g4882/AFMa245wd5/D1S2678<br>g4901/AFMa247wg9/D1S2680/ |
| 647 | 9-16022-325 | 5q31.3–q32 | g1166/AFM066xf11/D5S396<br>g20471/RH60098/WI-10312/ |
| 648 | 9-16023-160 | 5q31.3–q32 | g1166/AFM066xf11/D5S396<br>g20471/RH60098/WI-10312/ |
| 649 | 9-16030-317 | 5q31.3–q32 | g1166/AFM066xf11/D5S396<br>g20471/RH60098/WI-10312/ |

TABLE 9-continued

| SEQ ID No. | Marker Name | Chromosomal Localization | Adjacent STS (including aliases) |
|---|---|---|---|
| 650 | 9-1605-112 | 1q43 | g1262/AFM088xe5/D1S2850<br>g17846/RH12368/stSG3536<br>g18893/RH34172/L18266/SHGC-4752<br>g307/WI-11654/RH50099/RH63795/R10130<br>g317/EST382595/RH49984/SGC34592<br>g402/D1S1680/G09467<br>g421/WI-12850/RH50542/Z41492<br>g4882/AFMa245wd5/D1S2678<br>g4901/AFMa247wg9/D1S2680/ |
| 651 | 9-1607-373 | 1q43 | g1262/AFM088xe5/D1S2850<br>g17846/RH12368/stSG3536<br>g18893/RH34172/L18266/SHGC-4752<br>g307/WI-11654/RH50099/RH63795/R10130<br>g317/EST382595/RH49984/SGC34592<br>g402/D1S1680/G09467<br>g421/WI-12850/RH50542/Z41492<br>g4882/AFMa245wd5/D1S2678<br>g4901/AFMa247wg9/D1S2680/ |
| 652 | 9-1611-382 | 1q43 | g313/D1S3401/G04332<br>g404/D1S3450/G11836/ |
| 658 | 9-1615-118 | 1q43 | g313/D1S3401/G04332<br>g404/D1S3450/G11836/ |
| 667 | 9-1622-158 | 1q43 | g2259/AFM218zb6/D1S321/ |
| 670 | 9-1623-145 | 1q43 | g2259/AFM218zb6/D1S321/ |
| 677 | 9-16308-315 | 15q23 | g27865/D15S1242/ |
| 680 | 9-1637-345 | 1q43 | g2259/AFM218zb6/D1S321/ |
| 682 | 9-1638-571 | 1q43 | g2259/AFM218zb6/D1S321/ |
| 748 | 9-1701-39 | 8p23.2–p23.1 | g480/WI-9756/G05400/ |
| 758 | 9-1709-597 | 8p23.2–p23.1 | g480/WI-9756/G05400/ |
| 761 | 9-1710-249 | 8p23.2–p23.1 | g480/WI-9756/G05400/ |
| 908 | 9-18130-258 | 20p12 | g1846/AFM197xb12/D20S112/ |
| 931 | 9-18303-79 | 2q35 | g16358/WI-15771/EST226018/WI-15771/RH56329/<br>R54614<br>g879/EST387886/RH56672/SGC32531<br>g895/WI-15771/EST226018/R54614<br>g897/WI-19704<br>g900/WI-20003/RH56649/T19369/ |
| 936 | 9-18341-95 | 2q35 | g11465/WI-11020/EST206594/WI-11020/RH56985/<br>R36533<br>g24950/SHGC-6253/G02482<br>g891/EST165729/SGC33785/T95608<br>g892/RH56759/NIB1635/T16652<br>g893/WI-11020/EST206594/R36533<br>g894/WI-14333/EST228327/RH57030/R44333<br>g896/WI-22153/RH56193/ |
| 937 | 9-18344-284 | 2q35 | g11465/WI-11020/EST206594/WI-11020/RH56985/<br>R36533<br>g24950/SHGC-6253/G02482<br>g891/EST165729/SGC33785/T95608<br>g892/RH56759/NIB1635/T16652<br>g893/WI-11020/EST206594/R36533<br>g894/WI-14333/EST228327/RH57030/R44333<br>g896/WI-22153/RH56193/ |
| 938 | 9-18345-107 | 2q35 | g11465/WI-11020/EST206594/WI-11020/RH56985/<br>R36533<br>g24950/SHGC-6253/G02482<br>g891/EST165729/SGC33785/T95608<br>g892/RH56759/NIB1635/T16652<br>g893/WI-11020/EST206594/R36533<br>g894/WI-14333/EST228327/RH57030/R44333<br>g896/WI-22153/RH56193/ |
| 939 | 9-18371-433 | 2q33 | g678/WI-14342/R43945/ |
| 940 | 9-18373-27 | 2q33 | g678/WI-14342/R43945/ |
| 941 | 9-18375-237 | 2q33 | g678/WI-14342/R43945/ |
| 942 | 9-18379-485 | 2q33 | g678/WI-14342/R43945/ |
| 973 | 9-18602-241 | 1q42.3–q43 | g312/D1S3398/G04103/ |
| 974 | 9-18606-324 | 1q42.3–q43 | g312/D1S3398/G04103/ |
| 976 | 9-18612-184 | 1q42.3–q43 | g312/D1S3398/G04103/ |
| 977 | 9-18618-455 | 2q34 | g5200/AFMa351zd1/D2S2242/ |
| 978 | 9-18620-125 | 2q34 | g5200/AFMa351zd1/D2S2242/ |
| 982 | 9-18648-71 | 2q34–q35 | g2044/AFM205yb4/D2S295/ |
| 986 | 9-18715-172 | 17q23–q24 | g1684/AFM168xd12/D17S794/ |
| 987 | 9-18719-225 | 2q34–q35 | g6159/AFMc009yh1/D2S2322/ |
| 988 | 9-18720-235 | 2q34–q35 | g6159/AFMc009yh1/D2S2322/ |
| 989 | 9-18721-442 | 2q34–q35 | g6159/AFMc009yh1/D2S2322/ |
| 993 | 9-18744-170 | 2p13–p12;2q35 | g731/D2S2722/ |

TABLE 9-continued

| SEQ ID No. | Marker Name | Chromosomal Localization | Adjacent STS (including aliases) |
|---|---|---|---|
| 994 | 9-18745-423 | 2p13–p12;2q35 | g731/D2S2722/ |
| 995 | 9-18747-72 | 2p13–p12;2q35 | g731/D2S2722/ |
| 1002 | 9-18808-155 | 11q23–q24 | g4760/AFMa222xc5/D11S4104/ |
| 1003 | 9-18814-275 | 18q12.3–q21.1 | g1510/AFM147yf2/D18S1094/ |
| 1017 | 9-18974-99 | 8p23.1 | g21326/RH62553/T03554/IB46 g23/SHGC-9737/G13478 g26491/SHGC-33472/R01769/ |
| 1018 | 9-18976-135 | 8p23.1 | g21326/RH62553/T03554/IB46 g23/SHGC-9737/G13478 g26491/SHGC-33472/R01769/ |
| 1019 | 9-18982-345 | 8p23.1 | g21326/RH62553/T03554/IB46 g23/SHGC-9737/G13478 g26491/SHGC-33472/R01769/ |
| 1020 | 9-18986-248 | 8p23.1 | g21326/RH62553/T03554/IB46 g23/SHGC-9737/G13478 g26491/SHGC-33472/R01769/ |
| 1021 | 9-18987-191 | 4q12–q13.1 | g3031/AFM292xe1/D4S1592 g3712/AFMa044tf1/D4S3019/ |
| 1022 | 9-18995-300 | 4q12–q13.1 | g3031/AFM292xe1/D4S1592 g3712/AFMa044tf1/D4S3019/ |
| 1023 | 9-18996-388 | 4q12–q13.1 | g3031/AFM292xe1/D4S1592 g3712/AFMa044tf1/D4S3019/ |
| 1031 | 9-19253-102 | 4q12 | g11759/WI-11762/EST183347/RH59610/R12768 g14673/D452603/MR10551 g20013/RH59475/SGC35370/ |
| 1032 | 9-19256-149 | 4q12 | g11759/WI-11762/EST183347/RH59610/R12768 g14673/D4S2603/MR10551 g20013/RH59475/SGC35370/ |
| 1041 | 9-1964-53 | 1q43 | g15623/D1S547/GATA4A09 g17350/RH1290/SHGC-477 g17708/RH11033/D29436/D29436 g18500/RH26479/R65593 g319/EST161941/RH50228/RH64454/SGC33718/ T91820 g405/D1S1707/G02394 g408/AFM214xe11/Z66804 g417/D1S2421/WI-9317/D29955/RH49709 g420/WI-15754/RH49799 g426/WI-13731/RH49867/RH64343/R44970/ |
| 1042 | 9-1977-440 | 1q43 | g15623/D1S547/GATA4A09 g17350/RH1290/SHGC-477 g17708/RH11033/D29436/D29436 g18500/RH26479/R65593 g319/EST161941/RH50228/RH64454/SGC33718/ T91820 g405/D1S1707/G02394 g408/AFM214xe11/Z66804 g417/D1S2421/WI-9317/D29955/RH49709 g420/WI-15754/RH49799 g426/WI-13731/RH49867/RH64343/R44970/ |
| 1044 | 9-19999-92 | 4p14;8p22 | g1951/AFM200yc7/D4S1547/ |
| 1046 | 9-20000-252 | 4p14;8p22 | g1951/AFM200yc7/D4S1547/ |
| 1076 | 9-20294-274 | 4p14 | g5753/AFMb319ze5/D4S2974/ |
| 1077 | 9-20303-127 | 4p14 | g5753/AFMb319ze5/D4S2974/ |
| 1078 | 9-20313-311 | 4p14 | g5753/AFMb319ze5/D4S2974/ |
| 1079 | 9-20320-321 | 4p14 | g19996/RH59112/R77106/SGC34270/ |
| 1080 | 9-20326-130 | 4p14 | g19996/RH59112/R77106/SGC34270/ |
| 1081 | 9-20332-432 | 4p14 | g19996/RH59112/R77106/SGC34270/ |
| 1082 | 9-20335-48 | 4p14 | g19996/RH59112/R77106/SGC34270/ |
| 1083 | 9-20340-161 | 4p14 | g19996/RH59112/R77106/SGC34270/ |
| 1090 | 9-20385-215 | 4p14;8p22 | g1951/AFM200yc7/D4S1547/ |
| 1099 | 9-20469-213 | 4p14 | g12593/WI-14683/EST283388/RH59148 g25359/SHGC4-1576/Z23989/ |
| 1101 | 9-20480-233 | 4p14 | g12593/WI-14683/EST283388/RH59148 g25359/SHGC4-1576/Z23989/ |
| 1102 | 9-20481-131 | 4p14 | g12593/WI-14683/EST283388/RH59148 g25359/SHGC4-1576/Z23989/ |
| 1103 | 9-20485-269 | 4p14 | g12593/WI-14683/EST283388/RH59148 g25359/SHGC4-1576/Z23989/ |
| 1104 | 9-20493-238 | 4p14 | g12593/WI-14683/EST283388/RH59148 g25359/SRGC4-1576/Z23989/ |
| 1105 | 9-20499-364 | 4p14 | g12593/WI-14683/EST283388/RH59148 g25359/SHGC4-1576/Z23989/ |
| 1106 | 9-20504-90 | 4p14 | g12593/WI-14683/EST283388/RH59148 g25359/SHGC4-1576/Z23989/ |

TABLE 9-continued

| SEQ ID No. | Marker Name | Chromosomal Localization | Adjacent STS (including aliases) |
|---|---|---|---|
| 1107 | 9-20508-456 | 4p14 | g12593/WI-14683/EST283388/RH59148 g25359/SRGC4-1576/Z23989/ |
| 1109 | 9-20511-221 | 4p14 | g12593/WI-14683/EST283388/RH59148 g25359/SHGC4-1576/Z23989/ |
| 1110 | 9-20514-71 | 4p14 | g12593/WI-14683/EST283388/RH59148 g25359/SHGC4-1576/Z23989/ |
| 1180 | 9-20938-256 | 6q22.1–q22.2 | g2096/AFM207xb6/D6S412/ |
| 1182 | 9-20950-251 | 2p21–p16 | g19180/RH56202/L47574/WI-18791/ |
| 1184 | 9-21012-277 | 6q12–q13 | g6016/AFMb352wc1/D6S1659/ |
| 1185 | 9-21021-273 | 6q12–q13 | g6016/AFMb352wc1/D6S1659/ |
| 1198 | 9-2117-107 | 21q22.1 | g1505/AFM147xb12/D21S260 g7678/D21S12 g7852/D21S1824 g7867/D21S1839/ |
| 1199 | 9-21221-96 | 3p24.3–p25.1 | g24997/D3S4113/ |
| 1221 | 9-2209-111 | 10p12.1–p11.2 | g1397/AFM119xh12/D10S197/ |
| 1228 | 9-2214-148 | 10p12.1–p11.2 | g1397/AFM119xh12/D10S197/ |
| 1233 | 9-2218-219 | 10p12.1–p11.2 | g1397/AFM119xh12/D10S197/ |
| 1235 | 9-2219-245 | 10p12.1–p11.2 | g1397/AFM119xb12/D10S197/ |
| 1239 | 9-2220-300 | 10p12.1–p11.2 | g1397/AFM119xh12/D10S197/ |
| 1240 | 9-2209-304 | 11q22.3–q23.1 | g22439/RH51746/WI-14282/ |
| 1243 | 9-2222-459 | 10p12.1–p11.2 | g1397/AFM119xh12/D10S197/ |
| 1245 | 9-22255-384 | 20q13.1–q13.2 | g17162/WI-31010/EST384826/RH57250/RH64058/SGC31010/ |
| 1246 | 9-22262-331 | 19q13.1 | g11280/TIGR-A005D28/RH55812 g11653/WI-11537/EST180053/RH56022/R09757/ |
| 1249 | 9-2228-301 | 21q21 | g7672/D21S11/ |
| 1250 | 9-2229-240 | 21q21 | g7672/D21S11/ |
| 1254 | 9-2235-499 | 21q21 | g7672/D21S11/ |
| 1257 | 9-2240-281 | 21q22.1 | g7689/D21S1230/ |
| 1259 | 9-2242-206 | 21q22.1 | g7689/D21S1230/ |
| 1260 | 9-2244-83 | 21q22.1 | g7689/D21S1230/ |
| 1261 | 9-22442-147 | 1p31.3–p31.2 | g18161/RH17161 g18429/RH25834/Z45206/ |
| 1262 | 9-22449-216 | 1p31.3–p31.2 | g18161/RH17161 g18429/RH25834/Z45206/ |
| 1263 | 9-22453-370 | 1p31.3–p31.2 | g18161/RH17161 g18429/RH25834/Z45206/ |
| 1264 | 9-22456-55 | 1p31.3–p31.2 | g18161/RH17161 g18429/RH25834/Z45206/ |
| 1265 | 9-2246-340 | 21q22.1 | g7689/D21S1230/ |
| 1266 | 9-2248-76 | 21q22.1 | g7689/D21S1230/ |
| 1269 | 9-2250-236 | 21q22.1 | g7689/D21S1230/ |
| 1274 | 9-22546-125 | 3q26.2–q26.3 | g16578 g19824/RH58812/R39509/WI-11077/ |
| 1275 | 9-22565-114 | 14q24.3–q31 | g23143/RH53688/G04281/WI-3377 g27731/D14S929/ |
| 1276 | 9-22571-136 | 14q24.3–q31 | g23143/RH53688/G04281/WI-3377 g27731/D14S929/ |
| 1282 | 9-22604-208 | 1p32.1–p31.3 | g11032/RH49618/NIB551/T17225 g12546/WI-14549/EST42945/RH50683/T17225/ |
| 1283 | 9-22610-343 | 15q21 | g12995/WI-15792/EST265261/RH54066 g27831/SHGC-9535/ |
| 1284 | 9-22615-392 | 15q21 | g12995/WI-15792/EST265261/RH54066 g27831/SHGC-9535/ |
| 1285 | 9-22617-378 | 15q21 | g12995/WI-15792/EST265261/RH54066 g27831/SHGC-9535/ |
| 1286 | 9-22620-404 | 19q13.4 | g12950/WI-15666/EST230907/RH55986/R44502/ |
| 1287 | 9-22628-292 | 15q24 | g16003/WI-20012/EST48352/RH54344/T28573 g23432/RH54202/WI-7231/ |
| 1288 | 9-22629-124 | 15q24 | g16003/WI-20012/EST48352/RH54344/T28573 g23432/RH54202/WI-7231/ |
| 1289 | 9-22632-237 | 15q24 | g16003/WI-20012/EST48352/RH54344/T28573 g23432/RH54202/WI-7231/ |
| 1290 | 9-22646-233 | 6q21 | g5686/AFMb312yc1/D6S1635/ |
| 1291 | 9-22648-57 | 6q21 | g5686/AFMb312yc1/D6S1635/ |
| 1292 | 9-22650-64 | 6q21 | g5686/AFMb312yc1/D6S1635/ |
| 1293 | 9-22652-343 | 8q24.2 | g5926/AFMb340xd5/D8S1783/ |
| 1294 | 9-22655-319 | 8q24.2 | g5926/AFMb340xd5/D8S1783/ |
| 1295 | 9-22660-386 | 8q24.2 | g5926/AFMb340xd5/D8S1783/ |
| 1296 | 9-22662-268 | 8q24.2 | g5926/AFMb340xd5/D8S1783/ |
| 1297 | 9-22666-164 | 4p15.3–p15.2 | g19966/RH58930/L14153/D4S1267/ |
| 1298 | 9-22668-232 | 4p15.3–p15.2 | g19966/RH58930/L14153/D4S1267/ |
| 1299 | 9-22674-31 | 4p15.3–p15.2 | g19966/RH58930/L14153/D4S1267/ |
| 1300 | 9-22675-187 | 4p15.3–p15.2 | g19966/RH58930/L14153/D4S1267/ |
| 1301 | 9-22680-130 | 18p11.31 | g23841/RH55516/G03618/WI-4219/ |

TABLE 9-continued

| SEQ ID No. | Marker Name | Chromosomal Localization | Adjacent STS (including aliases) |
|---|---|---|---|
| 1302 | 9-22683-107 | 18p11.31 | g23841/RH55516/G03618/WI-4219/ |
| 1304 | 9-22700-358 | 11q23.1–q23.2; 5q11.2 | g27251/SHGC-2090/Z24364/RH13666 g3346/AFM320Xh1/D11S1347/ |
| 1305 | 9-22701-307 | 11q23.1–q23.2; 5q11.2 | g27251/SHGC12090/Z24364/RH13666 g3346/AFM320xh1/D11S1347/ |
| 1312 | 9-22733-281 | 2q35 | g19425/RH56275/H62242/SGC32398/RH56275/ |
| 1313 | 9-22741-180 | 2q34–q35 | g6159/AFMc009yh1/D2S2322/ |
| 1316 | 9-22771-150 | 2q35 | g24953/SRGC-971/Z17049 g4193/AFMa109wg5/D2S2151/ |
| 1317 | 9-22775-365 | 2q35 | g24953/SHGC-971/Z17049 g4193/AFMa109wg5/D2S2151/ |
| 1319 | 9-22785-431 | 2q35 | g24953/SHGC-971/Z17049 g4193/AFMa109wg5/D2S2151/ |
| 1320 | 9-22843-342 | 2q35 | g874/WI-12463/EST195179/R25134/ |
| 1321 | 9-22844-211 | 2q35 | g874/WI-12463/EST195179/R25134/ |
| 1323 | 9-22868-425 | 2q33 | g1453/AFM135xf12/D2S2396/ |
| 1324 | 9-22872-431 | 2q33 | g1453/AFM135xf12/D2S2396/ |
| 1325 | 9-2288-144 | 21q21.3 | g5554/AFMb291yb9/D21S1896 g7754/D21S1435/ |
| 1326 | 9-22917-145 | 2q32.3–q33 | g6130/AFMc005wb9/D2S2318/ |
| 1328 | 9-22948-262 | 2p23 | g10323/AFMB353WF1/w2082/ |
| 1329 | 9-22954-306 | 2p23 | g10323/AFMB353WF1/w2082/ |
| 1330 | 9-22957-409 | 2p23 | g10323/AFMB353WF1/w2082/ |
| 1331 | 9-22959-239 | 2p23 | g10323/AFMB353WF1/w2082/ |
| 1332 | 9-22964-82 | 11p15.5–p15.4 | g6052/AFMb355za9/D11S4177/ |
| 1333 | 9-22975-126 | 11p15.5–p15.4 | g6052/AFMb355za9/D11S4177/ |
| 1334 | 9-23014-300 | 2q34–q35 | g2044/AFM205yb4/D2S295/ |
| 1335 | 9-23018-166 | 2q34–q35 | g2044/AFM205yb4/D2S295/ |
| 1336 | 9-23020-187 | 1q43 | g422/WI-15487/RH50392/RH64322/R39926 g431/WI-31075/RH50186/RH64283/SGC31075/ |
| 1337 | 9-23083-59 | 1p34.2–p34.1 | g18865/RH33933/G07594/SHGC-4031/ |
| 1338 | 9-23100-367 | 9q33–q34.1 | g15044/D9S1698/HSC0VC072/ |
| 1339 | 9-23115-404 | 22q12;2p23 | g19151/RH57021/R95095/SGC33508 g19152/RH56155/WI-10842/ |
| 1340 | 9-23118-402 | 22q12;2p23 | g19151/RH57021/R95095/SGC33508 g19152/RH56155/WI-10842/ |
| 1341 | 9-2312-358 | 21q21.2 | g7697/D21S1240/ |
| 1342 | 9-23123-250 | 3p21.1–p14.3 | g2744/AFM268wg9/D3S1578/ |
| 1343 | 9-23127-314 | 3p21.1–p14.3 | g2744/AFM268wg9/D3S1578/ |
| 1344 | 9-23132-192 | 3p21.1–p14.3 | g2744/AFM268wg9/D3S1578/ |
| 1345 | 9-23134-89 | 3p21.1–p14.3 | g2744/AFM268wg9/D3S1578/ |
| 1346 | 9-2315-213 | 21q21.2 | g7697/D21S1240/ |
| 1347 | 9-23150-262 | 18q23 | g13666/WI-18089/EST355463/RH55492 g28291/SHGC-17251/ |
| 1348 | 9-2320-292 | 21q21.2 | g7697/D21S1240/ |
| 1349 | 9-23201-345 | 4q31.1–q31.2 | g16662/WI-15195/EST308096/RH59447 g25614/D4S507 g6094/AFMb361zg5/D4S2998/ |
| 1350 | 9-23202-185 | 4q31.1–q31.2 | g16662/WI-15195/EST308096/RH59447 g25614/D4S507 g6094/AFMb361zg5/D4S2998/ |
| 1351 | 9-23204-262 | 4q31.1–q31.2 | g16662/WI-15195/EST308096/RH59447 g25614/D4S507 g6094/AFMb361zg5/D4S2998/ |
| 1352 | 9-23207-281 | 4q31.1–q31.2 | g16662/WI-15195/EST308096/RH59447 g25614/D4S507 g6094/AFMb361zg5/D4S2998/ |
| 1353 | 9-2321-82 | 21q21.2 | g7697/D21S1240/ |
| 1354 | 9-23228-176 | 2q21 | g19179/RH56626/T10467/SGC32727 g19285/RH56961/R51826/SGC31844/ |
| 1355 | 9-2324-338 | 21q21.2 | g7697/D21S1240/ |
| 1358 | 9-2328-535 | 10p11.2 | g1912/AFM199zb6/D10S213/ |
| 1359 | 9-23299-424 | 3q21 | g5752/AFMb319yf1/D3S3646/ |
| 1360 | 9-23302-326 | 3q21 | g5752/AFMb319yf1/D3S3646/ |
| 1361 | 9-2331-639 | 21q22.1 | g7774/D21S1677 g7876/D21S1853 g7877/D21S1854 g7886/D21S1865 g7887/D21S1866/ |
| 1362 | 9-23312-93 | 3q21 | g5752/AFMb319yf1/D3S3646/ |
| 1363 | 9-23317-51 | 1q32.1 | g5230/AFMb002ya5/D1S2716/ |
| 1364 | 9-23322-49 | 1q32.1 | g5230/AFMb002ya5/D1S2716/ |
| 1365 | 9-23326-120 | 1q32.1 | g5230/AFMb002ya5/D1S2716/ |
| 1366 | 9-23328-292 | 1q32.1 | g5230/AFMb002ya5/D1S2716/ |
| 1367 | 9-23333-157 | 9p22 | g10403/D9S921/GATA-D9S921 g26676/SHGC-3751/Z16707/RH13288/ |

TABLE 9-continued

| SEQ ID No. | Marker Name | Chromosomal Localization | Adjacent STS (including aliases) |
|---|---|---|---|
| 1368 | 9-23334-443 | 9p22 | g10403/D9S921/GATA-D9S921 g26676/SHGC-3751/Z16707/RH13288/ |
| 1369 | 9-23359-99 | 2q35 | g878/RH56992/SGC35345/ |
| 1370 | 9-23381-412 | 2q34 | g5200/AFMa351zd1/D2S2242/ |
| 1371 | 9-23387-404 | 2q34 | g5200/AFMa351zd1/D2S2242 / |
| 1372 | 9-23413-242 | 11q23.3–q24 | g2707/AFM265wa9/D11S1328/ |
| 1373 | 9-23415-131 | 11q23.3–q24 | g2707/AFM265wa9/D11S1328/ |
| 1374 | 9-23417-128 | 11q23.3–q24 | g2707/AFM265wa9/D11S1328/ |
| 1378 | 9-2345-28 | 13p13–q11; 14p13–q11.1; 15p13–q11.1; 16p11.1–q11.2; 1p11–q12; 21p13–q11.1; 3p11–q11.1; 9p11–q12; Yq12 | g6058/AFMb356wg1/D21S1904 g7727/D21S13 g7737/D21S1416 g7750/D21S1431/ |
| 1383 | 9-23462-192 | 1q21.1–q21.2 | g17255/RH421/Z24671/SHGC-1599/RH13725 g19054/RH36179/H47260/stSG12720/ |
| 1384 | 9-23463-118 | 1q21.1–q21.2 | g17255/RH421/Z24671/SHGC-1599/RH13725 g19054/RH36179/H47260/stSG12720/ |
| 1386 | 9-2347-207 | 13p13–q11; 14p13–q11.1; 15p13–q11.1; 16p11.1–q11.2; 1p11–q12; 21p13–q11.1; 3p11–q11.1; 9p11–q12; Yq12 | g6058/AFMb356wg1/D21S1904 g7727/D21S13 g7737/D21S1416 g7750/D21S1431/ |
| 1388 | 9-2348-127 | 13p13–q11; 14p13–q11.1; 15p13–q11.1; 16p11.1–q11.2; 1p11–q12; 21p13–q11.1; 3p11–q11.1; 9p11–q12; Yq12 | g6058/AFMb356wg1/D21S1904 g7727/D21S13 g7737/D21S1416 g7750/D21S1431/ |
| 1394 | 9-2356-322 | 13p13–q11;14p13–q11.1;15p13–q11.1;16p11.1–q11.2;1p11–q12;21p13–q11.1;3p11–q11.1;9p11–q12;Yq12 | g6058/AFMb3S6wg1/D21S1904 g7727/D21S13 g7737/D21S1416 g7750/D21S1431/ |
| 1395 | 9-2362-270 | 21q21–q22.1 | g7899/D21S1877 g7904/D21S1881/ |
| 1396 | 9-2364-329 | 21q21–q22.1 | g7899/D21S1877 g7904/D21S1881/ |
| 1397 | 9-2367-61 | 21q21–q22.1 | g7899/D21S1877 g7904/D21S1881/ |
| 1398 | 9-2368-61 | 21q21–q22.1 | g7899/D21S1877 g7904/D21S1881/ |
| 1399 | 9-23687-107 | 2q34 | g2193/AFM212ze9/D2S157/ |
| 1400 | 9-237-151 | 21q22.3 | g7967/D21S49/ |
| 1401 | 9-23714-196 | 15q23 | g27865/D15S1242/ |
| 1403 | 9-2375-114 | 21q11.2 | g7010/D21S258 g7029/AFMa083xe1/ |
| 1405 | 9-2378-200 | 21q11.2 | g7010/D21S258 g7029/AFMa083xe1/ |
| 1406 | 9-2381-394 | 21q11.2 | g7010/D21S258 g7029/AFMa083xe1/ |
| 1409 | 9-2413-368 | 21q22.1 | g7798/D21S1700 g7879/D21S1856/ |
| 1410 | 9-2417-177 | 21q22.1 | g7798/D21S1700 g7879/D21S1856/ |
| 1411 | 9-2419-285 | 21q22.1 | g7798/D21S1700 g7879/D21S1856/ |
| 1412 | 9-24246-247 | 2q33 | g649/Mch4 g651/RH15884/T91183/ |
| 1413 | 9-24253-437 | 2q35 | g15152/D2S2592/UTR-05171/ |
| 1414 | 9-24259-466 | 2q35 | g15152/D2S2592/UTR-05171/ |
| 1415 | 9-24264-380 | 2q35 | g15152/D2S2592/UTR-05171/ |

TABLE 9-continued

| SEQ ID No. | Marker Name | Chromosomal Localization | Adjacent STS (including aliases) |
|---|---|---|---|
| 1416 | 9-24269-417 | 2q33–q34 | g2141/AFM210yf10/D2S155/ |
| 1417 | 9-24270-207 | 2q33–q34 | g2141/AFM210yf10/D2S155/ |
| 1419 | 9-24284-213 | 2q33–q34 | g732/RH56861/ |
| 1420 | 9-24286-231 | 2q33–q34 | g732/RH56861/ |
| 1421 | 9-24288-121 | 2q33–q34 | g732/RH56861/ |
| 1422 | 9-24333-37 | 2q34 | g882/EST141512/RH56286/SGC33506/T79149/ |
| 1423 | 9-24342-311 | 2q35 | g679/EST250412/RH56354/SGC31996/ |
| 1424 | 9-24376-24 | 7q11.23–q21.1 | g11961/WI-12513/EST251317/RH61608/R74459/ |
| 1425 | 9-24379-319 | 7q11.23–q21.1 | g11961/WI-12513/EST251317/RH61608/R74459/ |
| 1429 | 9-24390-27 | 10q11.2 | g21928/RH51060/SGC38063/ |
| 1430 | 9-24392-61 | 10q11.2 | g21928/RH51060/SGC38063/ |
| 1431 | 9-24393-108 | 10q11.2 | g21928/RH51060/SGC38063/ |
| 1433 | 9-24409-383 | 14q24.3 | g23123/RH53961/T40920/SGC32981/SHGC-32981/ |
| 1434 | 9-24411-420 | 14q24.3 | g23123/RH53961/T40920/SGC32981/SHGC-32981/ G27696/G25597/EST91724 g27725/SHGC-942/Z16981/RH49039/ |
| 1435 | 9-24427-321 | 5q34 | g1927/AFM200vf6/D5S619/ |
| 1436 | 9-24432-284 | 5q34 | g1927/AFM200vf6/D5S619/ |
| 1439 | 9-24447-448 | 1p31.3–p31.2 | g14348/D1S2161/MR7398 g18605/RH27953/G07842/ |
| 1441 | 9-24454-257 | 1p31.3–p31.2 | g14348/D1S2161/MR7398 g18605/RH27953/G07842/ |
| 1442 | 9-24463-206 | 21q21–q22.1 | g24227/RH57563/H92581/WI-22816 g7742/D21S1422 |
| 1443 | 9-24496-171 | 11q23.3–q24 | g22500/RH52371/H30529/SGC30738 |
| 1444 | 9-24506-396 | 4q25 | g20076/RH59480/Z15005/WI-6987 g20078/RH59042/T16396/WI-13405/ |
| 1445 | 9-24508-45 | 4q25 | g20076/RH59480/Z15005/WI-6987 g20078/RH59042/T16396/WI-13405/ |
| 1446 | 9-24529-330 | 2q35 | g16358/WI-15771/EST226018/WI-15771/RH56329/ R54614 g879/EST387886/RH56672/SGC32531 g895/WI-15771/EST226018/R54614 g897/WI-19704 g900/WI-20003/RH56649/T19369/ |
| 1447 | 9-24534-317 | 2q35 | g16358/WI-15771/EST226018/WI-15771/RH56329/ R54614 g879/EST387886/RH56672/SGC32531 g895/WI-15771/EST226018/R54614 g897/WI-19704 g900/WI-20003/RH56649/T19369/ |
| 1448 | 9-24554-324 | 2q35 | g875/WI-12994/HSC2KC082 g876/WI-17411/EST240716/RH56866/R63961/ |
| 1449 | 9-24557-406 | 2q35 | g5212/AFMa357wc9/D2S2244/ |
| 1450 | 9-24561-360 | 2q35 | g13275/WI-16791/EST159864/WI-16791/RH56414/ T89743 g889/WI-16791/EST159864/T89743/ |
| 1451 | 9-24570-260 | 6q26 | g15128/D6S1951/UTR-00083/ |
| 1453 | 9-24725-138 | 16q21–q22; 7p11.1–q11.1 | g12359/WI-13905/EST227346/RH54662/R49366 g16052/WI-20039/EST59759/RH54768/T33895 g27992/SHGC-11618/T56923/ |
| 1454 | 9-24727-360 | 16q21–q22; 7p11.1–q11.1 | g12359/WI-13905/EST227346/RH54662/R49366 g16052/WI-20039/EST59759/RH54768/T33895 g27992/SHGC-11618/T56923/ |
| 1455 | 9-24750-293 | 11q23.1–q23.2 | g15768 g22459/RH52046/H86791/SGC31226/ |
| 1456 | 9-24778-221 | 7q22 | g491/WI-6368/RH61376/ |
| 1457 | 9-24793-390 | 7q22 | g491/WI-6368/RH61376/ |
| 1458 | 9-24800-565 | 7q22 | g491/WI-6368/RH61376/ |
| 1461 | 9-25053-114 | 2q33–q34 | g6158/AFMc009wh1/D2S2321/ |
| 1462 | 9-25055-44 | 2q33–q34 | g6158/AFMc009wh1/D2S2321/ |
| 1463 | 9-25070-78 | 2q33–q34 | g6158/AFMc009wh1/D2S2321/ |
| 1467 | 9-2524-98 | 21q22.3 | g7967/D21S49/ |
| 1468 | 9-25246-170 | 13q34 | g15911 g712/RH17028/ |
| 1469 | 9-25249-151 | 13q34 | g15911 g712/RH17028/ |
| 1470 | 9-2525-142 | 21q22.3 | g7967/D21S49/ |
| 1471 | 9-25255-288 | 13q34 | g15911 g712/RH17028/ |
| 1472 | 9-25369-121 | 15q21 | g23347/RH54301/G05439/WI-9836 g23349/RH54281/H92576/SGC32630/ |
| 1478 | 9-25431-269 | 2q33–q34 | g881/WI-18179/EST362695/ |
| 1479 | 9-25432-119 | 2q33–q34 | g881/WI-18179/EST362695/ |
| 1480 | 9-25433-351 | 2q33–q34 | g881/WI-18179/EST362695/ |

TABLE 9-continued

| SEQ ID No. | Marker Name | Chromosomal Localization | Adjacent STS (including aliases) |
|---|---|---|---|
| 1481 | 9-25447-272 | 1q44 | g17338/RH1233/SHGC-269 g18240/RH17889/R98962/R98962 g18593/RH27933/RH64496/ |
| 1482 | 9-25448-348 | 18q11.2 | g10695/CHLC.GATA84D10/CHLC.GATA85D10.P19280/ G08009/GATA-P19280/ |
| 1483 | 9-25452-83 | 18q11.2 | g10695/CHLC.GATA85D10/CHLC.GATA85D10.P19280/ G08009/GATA-P19280/ |
| 1484 | 9-25454-349 | 18q11.2 | g10695/CHLC.GATA85D10/CHLC.GATA85D10.P19280/ G08009/GATA-P19280/ |
| 1500 | 9-2570-218 | 21q22.3 | g24258/RH57551/R48588/SGC34143 g24259/RH57619/H53556/SGC34732/ |
| 1502 | 9-25716-393 | 13q34 | g866/WI-13756/RH53429/R46080/ |
| 1503 | 9-25717-252 | 13q34 | g866/WI-13756/RH53429/R46080/ |
| 1507 | 9-25781-275 | 19q13.2 | g11925/WI-12417/EST276107/RH55689/ |
| 1509 | 9-2597-34 | 21q22.2 | g7732/D21S1411/ |
| 1510 | 9-26001-224 | 3q27–q28 | g11074/RH58557/Z22625/T40957 g19863/RH58270/H61445/SGC34843/ |
| 1511 | 9-26002-93 | 3q27–q28 | g11074/RH58557/Z22625/T40957 g19863/RH58270/H61445/SGC34843/ |
| 1512 | 9-26042-310 | 2q23 | g1807/AFM191wg9/D2S142/ |
| 1513 | 9-26080-152 | 11q24;5q15 | g4300/AFMa124wg5/D5S1957/ |
| 1514 | 9-26082-48 | 11q24;5q15 | g4300/AFMa124wg5/D5S1957/ |
| 1515 | 9-26099-119 | 1p22 | g17899/RH12743/R47991/stSG4580/ |
| 1517 | 9-26105-273 | 2q35 | g19425/RH56275/H62242/SGC32398/RH56275/ |
| 1518 | 9-26116-191 | 5q21–q22 | g13747/WI-18306/EST374223/RH59791 g20406/RH60017/H10223/SGC32412/ |
| 1521 | 9-2624-407 | 21q22.2 | g16433 g24246/RH57580/SGC32448 g28577/SHGC-10474 g28580/SHGC-10477 g7818/D21S1725E/ |
| 1522 | 9-2625-70 | 21q22.2 | g16433 g24246/RH57580/SGC32448 g28577/SHGC-10474 g28580/SHGC-10477 g7818/D21S1725E/ |
| 1523 | 9-2637-28 | 21q22.2 | g16433 g24246/RH57580/SGC32448 g28577/SHGC-10474 g28580/SHGC-10477 g7818/D21S1725E/ |
| 1528 | 9-342-288 | 19q13.2–q13.3 | g448/RH11470/RH1669/ |
| 1544 | 9-449-344 | 10p12.1–p11.2 | g3518/AFM338ta5/D10S600/ |
| 1545 | 9-4536-255 | 15q14–q15 | g15965/WI-11934/EST197813/RH54176/R27768 g15966/WI-19599/ |
| 1546 | 9-4541-39 | 1p36.2–p36.1 | g316/EST47321/D19656/RH50110/SGC32758 g414/WI-12386/RH50879/RH63782/ |
| 1547 | 9-4544-287 | 1p36.2–p36.1 | g316/EST47321/D19656/RH50110/SGC32758 g414/WI-12386/RH50879/RH63782/ |
| 1548 | 9-4547-312 | 1p36.2–p36.1 | g316/EST47321/D19656/RH50110/SGC32758 g414/WI-12386/RH50879/RH63782/ |
| 1549 | 9-4595-341 | 1q43 | g314/WI-10464/ |
| 1550 | 9-4604-26 | 1q43 | g314/WI-10464/ |
| 1555 | 9-465-443 | 10p12.1–p11.2 | g1621/AFM164tg9/D10S204/ |
| 1557 | 9-466-361 | 10p12.1–p11.2 | g1621/AFM164tg9/D10S204/ |
| 1569 | 9-472-70 | 10p11.2 | g2598/AFM254xb1/D10S224/ |
| 1591 | 9-490-202 | 10p12.1–p11.2 | g5171/AFMa346zd5/D10S1695 g5966/AFMb345ya9/D10S1732/ |
| 1594 | 9-4950-196 | 1q43 | g416/D1S3481/G13394/ |
| 1595 | 9-4951-36 | 1q43 | g416/D1S3481/G13394/ |
| 1599 | 9-5016-206 | 7q11.23–q21.1 | g1970/AFM203vb6/D7S634/ |
| 1600 | 9-5029-240 | 7q11.23–q21.1 | g1970/AFM203vb6/D7S634/ |
| 1605 | 9-5099-245 | 7q11.23–q21.1 | g2935/AFM286xf9/D7S669/ |
| 1606 | 9-5101-284 | 7q11.23–q21.1 | g2935/AFM286xf9/D7S669/ |
| 1607 | 9-5104-160 | 7q11.23–q21.1 | g2935/AFM286xf9/D7S669/ |
| 1608 | 9-5107-184 | 7q11.23–q21.1 | g2935 /AFM286xf9/D7S669/ |
| 1609 | 9-5108-144 | 7q11.23–q21.1 | g2935/AFM286xf9/D7S669/ |
| 1610 | 9-511-33 | 10p12.1–p11.2 | g4171/AFMa106vf5/D10S1639/ |
| 1633 | 9-5294-362 | 2q33 | g4971/AFMa285zb9/D2S2214 g4987/AFMa289xc1/D2S2217/ |
| 1634 | 9-5306-93 | 2q33 | g4971/AFMa285zb9/D2S2214 g4987/AFMa289xc1/D2S2217/ |
| 1635 | 9-5308-341 | 2q33 | g4971/AFMa285zb9/D2S2214 g4987/AFMa289xc1/D2S2217/ |
| 1636 | 9-5312-273 | 2q33 | g4971/AFMa285zb9/D2S2214 g4987/AFMa289xc1/D2S2217/ |

TABLE 9-continued

| SEQ ID No. | Marker Name | Chromosomal Localization | Adjacent STS (including aliases) |
|---|---|---|---|
| 1639 | 9-5355-165 | 1q43 | g430/RH50609/RH71064/SGC35584/ |
| 1640 | 9-5356-100 | 1q43 | g430/RH50609/RH71064/SGC35584/ |
| 1641 | 9-5360-151 | 1q43 | g430/RH50609/RH71064/SGC35584/ |
| 1642 | 9-5362-203 | 1q43 | g430/RH50609/RH71064/SGC35584/ |
| 1643 | 9-5364-95 | 1q43 | g430/RH50609/RH71064/SGC35584/ |
| 1644 | 9-5379-158 | 2p13 | g681/WI-9025/ |
| 1645 | 9-5386-85 | 2p13 | g681/WI-9025/ |
| 1654 | 9-5420-425 | 1q43 | g496/WI-20654/TWIK1/EST/RH50086/T89039/ |
| 1655 | 9-5427-466 | 1q43 | g496/WI-20654/TWIK1/EST/RH50086/T89039/ |
| 1656 | 9-5432-391 | 1q43 | g496/WI-20654/TWIK1/EST/RH50086/T89039/ |
| 1657 | 9-5433-45 | 1q43 | g496/WI-20654/TWIK1/EST/RH50086/T89039/ |
| 1658 | 9-5437-159 | 1q43 | g496/WI-20654/TWIK1/EST/RH50086/T89039/ |
| 1659 | 9-5438-70 | 1q43 | g496/WI-20654/TWIK1/EST/RH50086/T89039/ |
| 1660 | 9-5441-287 | 1q43 | g496/WI-20654/TWIK1/EST/RH50086/T89039/ |
| 1661 | 9-5446-303 | 1q43 | g496/WI-20654/TWIK1/EST/RH50086/T89039/ |
| 1662 | 9-5447-322 | 1q43 | g496/WI-20654/TWIK1/EST/RH50086/T89039/ |
| 1663 | 9-5458-203 | 2q32.3 | g2869/AFM280wd5/D2S342/ |
| 1664 | 9-5468-319 | 2q33.3–q34 | g1197/AFM074xg9/D2S307 g24934/SHGC-3548/Z23329/ |
| 1665 | 9-5472-290 | 2q34–q35 | g4057/AFMa082xc5/D2S2382 g680/D2S2606/XRCC5?/ |
| 1666 | 9-5475-455 | 2q34–q35 | g4057/AFMa082xc5/D2S2382 g680/D2S2606/XRCC5?/ |
| 1667 | 9-5477-207 | 2q34–q35 | g4057/AFMa082xc5/D2S2382 g680/D2S2606/XRCC5?/ |
| 1668 | 9-5485-325 | 2q34–q35 | g4057/AFMa082xc5/D2S2382 g680/D2S2606/XRCC5?/ |
| 1669 | 9-5490-368 | 2q34–q35 | g4057/AFMa082xc5/D2S2382 g680/D2S2606/XRCC5?/ |
| 1670 | 9-5494-205 | 2q34–q35 | g4057/AFMa082xc5/D2S2382 g680/D2S2606/XRCC5?/ |
| 1671 | 9-5502-433 | 2q34–q35 | g4057/AFMa082xc5/D2S2382 g680/D2S2606/XRCC5?/ |
| 1672 | 9-5505-226 | 2q33 | g19410/RH56788/H90757/SGC35219 g50057/RH67919 g733/WI-8988/D2S2634/G07066/ |
| 1673 | 9-5516-121 | 2q33 | g19410/RH56788/H90757/SGC35219 g50057/RH67919 g733/WI-8988/D2S2634/G07066/ |
| 1674 | 9-5526-334 | 2q33 | g19410/RH56788/H90757/SGC35219 g50057/RH67919 g733/WI-8988/D2S2634/G07066/ |
| 1675 | 9-5566-131 | 2q33 | g675/RH18054/ |
| 1676 | 9-5582-71 | 2q34–q35 | g19417/RH56312/R44983/SGC31824 g646/RH56681/SGC33209/R02572 g647/D2S2635 g887/WI-10220/EST135001/T72644/ |
| 1677 | 9-5590-99 | 2q34–q35 | g19417/RH56312/R44983/SGC31824 g646/RH56681/SGC33209/R02572 g647/D2S2635 g887/WI-10220/EST135001/T72644/ |
| 1678 | 9-5595-380 | 2q34–q35 | g19417/RH56312/R44983/SGC31824 g646/RH56681/SGC33209/R02572 g647/D2S2635 g887/WI-10220/EST135001/T72644/ |
| 1679 | 9-5596-216 | 2q34–q35 | g19417/RH56312/R44983/SGC31824 g646/RH56681/SGC33209/R02572 g647/D2S2635 g887/WI-10220/EST135001/T72644/ |
| 1680 | 9-5604-376 | 2q34–q35 | g19417/RH56312/R44983/SGC31824 g646/RH56681/SGC33209/R02572 g647/D2S2635 g887/WI-10220/EST135001/T72644/ |
| 1681 | 9-5608-324 | 2q34–q35 | g19417/RH56312/R44983/SGC31824 g646/RH56681/SGC33209/R02572 g647/D2S2635 g887/WI-10220/EST135001/T72644/ |
| 1753 | 9-6131-166 | 2q33 | g4971/AFMa285zb9/D2S2214 g4987/AFMa289xc1/D2S2217/ |
| 1754 | 9-6135-319 | 2q33 | g4971/AFMa285zb9/D2S2214 g4987/AFMa289xc1/D2S2217/ |
| 1756 | 9-6141-339 | 2q33 | g4971/AFMa285zb9/D2S2214 g4987/AFMa289xc1/D2S2217/ |
| 1759 | 9-6176-96 | 2q33.3–q34 | g1197/AFM074xg9/D2S307 g24934/SHGC-3548/Z23329/ |

TABLE 9-continued

| SEQ ID No. | Marker Name | Chromosomal Localization | Adjacent STS (including aliases) |
|---|---|---|---|
| 1760 | 9-6180-389 | 2q33.3–q34 | g1197/AFM074xg9/D2S307 g24934/SHGC-3548/Z23329/ |
| 1761 | 9-6181-328 | 2q33.3–q34 | g1197/AFM074xg9/D2S307 g24934/SHGC-3548/Z23329/ |
| 1762 | 9-6189-224 | 2p13 | g681/WI-9025/ |
| 1764 | 9-6191-252 | 2p13 | g681/WI-9025/ |
| 1765 | 9-6193-88 | 2p13 | g681/WI-9025/ |
| 1767 | 9-6217-420 | 2q32.3 | g2869/AFM280wd5/D2S342/ |
| 1769 | 9-6253-308 | 1q42.3–q43 | g498/WI-21544/EST/RH50234/R54815/ |
| 1770 | 9-6257-226 | 1q42.3–q43 | g498/WI-21544/EST/RH50234/R54815/ |
| 1771 | 9-6261-172 | 1q42.3–q43 | g498/WI-21544/EST/RH50234/R54815/ |
| 1772 | 9-6278-391 | 2q35 | g2382/AFM234xb8/D2S164 g5267/AFMb009zd5/D2S2248/ |
| 1773 | 9-6294-184 | 2q35 | g2382/AFM234xb8/D2S164 g5267/AFMb009zd5/D2S2248/ |
| 1774 | 9-6298-280 | 2q35 | g2382/AFM234xb8/D2S164 g5267/AFMb009zd5/D2S2248/ |
| 1775 | 9-6300-106 | 2q35 | g2382/AFM234xb8/D2S164 g5267/AFMb009zd5/D2S2248/ |
| 1776 | 9-6310-217 | 1q42.3–q43 | g498/WI-21544/EST/RH50234/R54815/ |
| 1782 | 9-6404-147 | 9q34.2 | g2548/AFM248wf1/D9S179 g26813/SHGC-3659/Z17118/ |
| 1783 | 9-6409-62 | 9q34.2 | g2548/AFM248wf1/D9S179 g26813/SHGC-3659/Z17118/ |
| 1784 | 9-6411-93 | 9q34.2 | g2548/AFM248wf1/D9S179 g26813/SHGC3659/Z17118/ |
| 1785 | 9-6413-369 | 9q34.2 | g2548/AFM248wf1/D9S179 g26813/SHGC-3659/Z17118/ |
| 1881 | 9-7098-382 | 11q23.3–q24 | g2274/AFM220xh6/D11S924 g5211/AFMa357wa5/D11S4129 g5947/AFMb342ze9/D11S4171/ |
| 1882 | 9-7103-155 | 11q23.3–q24 | g2274/AFM220xh6/D11S924 g5211/AFMa357wa5/D11S4129 g5947/AFMb342ze9/D11S4171/ |
| 1883 | 9-7104-187 | 11q23.3–q24 | g2274/AFM220xh6/D11S924 g5211/AFMa357wa5/D11S4129 g5947/AFMb342ze9/D11S4171/ |
| 1884 | 9-7107-143 | 11q23.3–q24 | g2274/AFM220xh6/D11S924 g5211/AFMa357wa5/D11S4129 g5947/AFMb342ze9/D11S4171/ |
| 1885 | 9-7114-31 | 11q23.3–q24 | g2274/AFM220xh6/D11S924 g5211/AFMa357wa5/D11S4129 g5947/AFMb342ze9/D11S4171/ |
| 1886 | 9-719-278 | 10q25.3–q26.1 | g5771/AFMb320zb5/D10S1722/ |
| 1892 | 9-7141-395 | 8p21 | g12037/WI-12748/RH62389/G13379/HSC2SC022/ |
| 1895 | 9-7167-438 | 1q43–q44 | g1317/AFM102xe3/D1S204 g5995/AFMb349xb9/D1S2785/ |
| 1896 | 9-7172-441 | 1q43–q44 | g1317/AFM102xe3/D1S204 g5995/AFMb349xb9/D1S2785/ |
| 1897 | 9-7177-81 | 1q43 | g12003/WI-12648/EST332992/RH49763/RH63832/R92197/ |
| 1899 | 9-7183-338 | 1q43 | g12003/WI-12648/EST332992/RH49763/RH63832/R92197/ |
| 1900 | 9-7193-228 | 1q43 | g12003/WI-12648/EST332992/RH49763/RH63832/R92197/ |
| 1902 | 9-7212-346 | 1q43 | g12003/WI-12648/EST332992/RH49763/RH63832/R92197/ |
| 1903 | 9-7214-109 | 8p21 | g12037/WI-12748/RH62389/G13379/HSC25C022/ |
| 1904 | 9-7218-444 | 8p21 | g12037/WI-12748/RH62389/G13379/HSC25C022/ |
| 1905 | 9-7234-101 | 11q23–q24 | g11907/WI-112357/EST142002/RH51673/T79639 g5745/AFMb318z19/D11S4157/ |
| 1907 | 9-7252-279 | 11q23.3 | g4523/AFMa162wf5/D11S4089/ |
| 1962 | 9-7671-33 | 11q24 | g5238/AFMb004z19/D11S4132/ |
| 1963 | 9-7677-107 | 11q24 | g5238/AFMb004z19/D11S4132/ |
| 1964 | 9-7688-325 | 11q23.3–q24 | g2707/AFM265wa9/D11S1328/ |
| 1965 | 9-7692-340 | 11q23.3–q24 | g2707/AFM265wa9/D11S1328/ |
| 1967 | 9-7706-303 | 11q24 | g5443/AFMb066zg9/D11S4144/ |
| 1969 | 9-7710-318 | 12q14–q15 | g5395/AFMb043wd1/D12S1649/ |
| 1970 | 9-7712-176 | 12q14–q15 | g5395/AFMb043wd1/D12S1649/ |
| 1971 | 9-7721-379 | 12q14–q15 | g5395/AFMb043wd1/D12S1649/ |
| 1972 | 9-7727-65 | 14q13; 15q13–q14 | g6091/AFMb361yh9/D14S1034/ |
| 1973 | 9-7728-334 | 14q13; 15q13–q14 | g6091/AFMb361yh9/D14S1034/ |
| 1974 | 9-7732-122 | 14q13; 15q13–q14 | g6091/AFMb361yh9/D14S1034/ |

TABLE 9-continued

| SEQ ID No. | Marker Name | Chromosomal Localization | Adjacent STS (including aliases) |
|---|---|---|---|
| 1975 | 9-7737-264 | 2q32.1–q32.2 | g19365/RH56584/SGC31527 g19370/RH57027/R78360/SGC34224 g2101/AFM207xg1/D2S152/ |
| 1976 | 9-7744-255 | 2q32.1–q32.2 | g19365/RH56584/SGC31527 g19370/RH57027/R78360/SGC34224 g2101/AFM207xg1/D2S152/ |
| 1977 | 9-7745-305 | 2q32.1–q32.2 | g19365/RH56584/SGC31527 g19370/RH57027/R78360/SGC34224 g2101/AFM207xg1/D2S152/ |
| 1978 | 9-7749-123 | 2q32.1–q32.2 | g19365/RH56584/SGC31527 g19370/RH57027/R78360/SGC34224 g2101/AFM207xg1/D2S152/ |
| 1979 | 9-7751-450 | 2q33 | g5710/AFMb315xd5/D2S2287/ |
| 1980 | 9-7753-199 | 2q33 | g5710/AFMb315xd5/D2S2287/ |
| 1981 | 9-7754-119 | 2q33 | g5710/AFMb315xd5/D2S2287/ |
| 1982 | 9-7759-63 | 2q33 | g5710/AFMb315xd5/D2S2287/ |
| 1983 | 9-7762-227 | 2q33 | g5710/AFMb315xd5/D2S2287/ |
| 1984 | 9-7764-161 | 2q33 | g5710/AFMb315xd5/D2S2287/ |
| 1985 | 9-7775-313 | 14q32.2 | g27781/SHGC-1408/Z23999/ |
| 1986 | 9-7784-31 | 11q23.3–q24 | g2623/AFM256za5/D11S936 g3466/AFM331yc5/D11S1353/ |
| 1987 | 9-7789-404 | 11q23.3–q24 | g2623/AFM256za5/D11S936 g3466/AFM331yc5/D11S1353/ |
| 1988 | 9-7792-173 | 11q23.3–q24 | g2623/AFM256za5/D11S936 g3466/AFM331yc5/D11S1353/ |
| 1989 | 9-7796-130 | 2q32.3–q33 | g6130/AFMc005wb9/D2S2318/ |
| 1990 | 9-7803-253 | 2q32.3–q33 | g6130/AFMc005wb9/D2S2318/ |
| 1992 | 9-7840-281 | 2q31–q32.1 | g5604/AFMb297xc1/D2S2273/ |
| 1994 | 9-7868-204 | 2q34–q35 | g2794/AFM273va9/D2S334/ |
| 1995 | 9-7869-135 | 2q34–q35 | g2794/AFM273va9/D2S334/ |
| 1996 | 9-7870-316 | 2q34–q35 | g2794/AFM273va9/D2S334/ |
| 1997 | 9-7877-363 | 2q34–q35 | g2794/AFM273va9/D2S334/ |
| 1998 | 9-7882-43 | 2q35 | g2211/AFM214ye1/D2S301/ |
| 1999 | 9-7883-411 | 2q35 | g2211/AFM214ye1/D2S301/ |
| 2000 | 9-7884-151 | 2q35 | g2211/AFM214ye1/D2S301/ |
| 2001 | 9-7893-226 | 2q35 | g2211/AFM214ye1/D2S301/ |
| 2002 | 9-7898-43 | 2q33–q34 | g3773/AFMa050ya5/D2S2358/ |
| 2003 | 9-7900-452 | 2q33–q34 | g3773/AFMa050ya5/D2S2358/ |
| 2005 | 9-7917-429 | 2q33–q34 | g3773/AFMa050ya5/D2S2358/ |
| 2024 | 9-806-152 | 13p13–q11; 14p13–q11.1; 15p13–q11.1; 1p11–q12; 21p13; 22p13–q11.1; 9p11–q12 | g7719/D21S1277/ |
| 2033 | 9-810-117 | 13p13–q11; 14p13–q11.1; 15p13–q12; 21p13; 22p13–q11.1; 9p11–q12 | g7719/D21S1277/ |
| 2087 | 9-8453-358 | 2q32.2 | g5488/AFMb082ye1/D2S2262/ |
| 2088 | 9-8454-152 | 2q32.2 | g5488/AFMb082ye1/D2S2262/ |
| 2089 | 9-8456-266 | 2q32.2 | g5488/AFMb082ye1/D2S2262/ |
| 2090 | 9-8457-239 | 2q32.2 | g5488/AFMb082ye1/D2S2262/ |
| 2091 | 9-8470-275 | 2q32.2 | g5488/AFMb082ye1/D2S2262/ |
| 2092 | 9-8472-152 | 2q32.2 | g5488/AFMb082ye1/D2S2262/ |
| 2093 | 9-8476-216 | 2q34 | g2193/AFM212ze9/D2S157/ |
| 2094 | 9-8478-385 | 2q34 | g2193/AFM212ze9/D2S157/ |
| 2095 | 9-8487-245 | 2q34 | g2193/AFM212ze9/D2S157/ |
| 2096 | 9-8491-339 | 2q34 | g2193/AFM212ze9/D2S157/ |
| 2097 | 9-8499-107 | 2q34 | g2193/AFM212ze9/D2S157/ |
| 2098 | 9-8505-269 | 2q36 | g643/T95608/SGC33785/EST165729/RH56667 g676/WI-11020/R36533/ |
| 2100 | 9-8510-44 | 2q36 | g643/T95608/SGC33785/EST165729/RH56667 g676/WI-11020/R36533/ |
| 2101 | 9-8514-434 | 2q36 | g643/T95608/SGC33785/EST165729/RH56667 g676/WI-11020/R36533/ |
| 2102 | 9-8530-209 | 2q36 | g643/T95608/SGC33785/EST165729/RH56667 g676/WI-11020/R36533/ |
| 2110 | 9-8583-146 | 14q13 | g3541/AFM340zd9/D14S1049/ |
| 2111 | 9-8588-369 | 14q13 | g3541/AFM340zd9/D14S1049/ |
| 2112 | 9-8590-287 | 14q13 | g3541/AFM340zd9/D14S1049/ |
| 2196 | 9-921-285 | 13q31.1 | g14575/D13S1196/MR8039 g8824/D13S1196/WI5275/ |

TABLE 9-continued

| SEQ ID No. | Marker Name | Chromosomal Localization | Adjacent STS (including aliases) |
|---|---|---|---|
| 2197 | 9-924-93 | 13q31.1 | g14575/D13S1196/MR8039 g8824/D13S1196/WI5275/ |
| 2200 | 9-9254-404 | 2q33.3 | g1909/AFM199yf2/D2S2237/ |
| 2201 | 9-926-98 | 13q31.1 | g14575/D13S1196/MR8039 g8824/D13S1196/WI5275/ |
| 2202 | 9-9263-283 | 2q33.3 | g1909/AFM199yf2/D2S2237/ |
| 2203 | 9-9271-70 | 2q33.3 | g1909/AFM199yf2/D2S2237/ |
| 2204 | 9-9274-246 | 2q33.3 | g1909/AFM199yf2/D2S2237/ |
| 2205 | 9-9276-163 | 2q33.3 | g1909/AFM199yf2/D2S2237/ |
| 2208 | 9-937-125 | 13q31.1 | g14575/D13S1196/MR8039 g8824/D13S1196/WI5275/ |
| 2218 | 9-941-265 | 13q31.1 | g14575/D13S1196/MR8039 g8824/D13S1196/WI5275/ |
| 2222 | 9-942-381 | 13q31.1 | g14575/D13S1196/MR8039 g8824/D13S1196/WI5275/ |
| 2233 | 9-949-214 | 13q31.1 | g14575/D13S1196/MR8039 g8824/D13S1196/WI5275/ |
| 2237 | 9-950-418 | 13q31.3 | g2255/AFM218yf10/D13S265 g8812/WI10332/ |
| 2239 | 9-952-252 | 13q31.3 | g2255/AFM218yf10/D13S265 g8812/WI10332/ |
| 2243 | 9-954-45 | 13q31.3 | g2255/AFM218yf10/D13S265 g8812/WI10332/ |
| 2253 | 9-958-92 | 13q31.3 | g2255/AFM218yf10/D13S265 g8812/WI10332/ |
| 2255 | 9-961-150 | 13q31.3 | g2255/AFM218yf10/D13S265 g8812/WI10332/ |
| 2256 | 9-963-395 | 13q22.3–q31.1 | g2243/AFM218xd12/D13S264 g2474/AFM240wh2/D13S170/ |
| 2257 | 9-965-165 | 13q22.3–q31.1 | g2243/AFM218xd12/D13S264 g2474/AFM240wh2/D13S170/ |
| 2258 | 9-967-306 | 13q22.3–q31.1 | g2243/AFM218xd12/D13S264 g2474/AFM240wh2/D13S170/ |
| 2259 | 9-976-246 | 13q22.3–q31.1 | g2243/AFM218xd12/D13S264 g2474/AFM240wh2/D13S170/ |
| 2260 | 9-979-343 | 13q22.3–q31.1 | g2243/AFM218xd12/D13S264 g2474/AFM240wh2/D13S170/ |
| 2420 | 9-1091-446 | 21q22.1–q22.2 | g7006/D21S211 g7724/D21S1283/ |
| 2445 | 9-1105-127 | 13p13–q11; 14p13–q11.1; 15p13–q12; 21p13–q11.1; 22p13–q11.1; 3p11–q11.2; 4p11–q11; 9p11–q12 | g9370/AFMG51E07/G51E07/ |
| 2585 | 9-1202-340 | 21q22.3 | g7781/D21S1684 g7882/D21S1859 g7889/D21S1868 g7893/D21S1871 g7897/D21S1875/ |
| 2587 | 9-1203-272 | 21q22.3 | g7781/D21S1684 g7882/D21S1859 g7889/D21S1868 g7893/D21S1871 g7897/D21S1875/ |
| 2597 | 9-1211-59 | 21q22.3 | g7781/D21S1684 g7882/D21S1859 g7889/D21S1868 g7893/D21S1871 g7897/D21S1875/ |
| 2655 | 9-12965-451 | 5q32 | g1840/AFM196xc7/D5S479/ |
| 2656 | 9-12969-128 | 5q32 | g1840/AFM196xc7/D5S479/ |
| 2657 | 9-12970-339 | 5q32 | g1840/AFM196xc7/D5S479/ |
| 2658 | 9-12973-162 | 5q32 | g1840/AFM196xc7/D5S479/ |
| 2675 | 9-1370-401 | 1q43 | g401/D1S2483/G04024 g428/EST386335/R1150010/SGC35175/ |
| 2706 | 9-14944-119 | 5q30.1–q31.2 | g1446/AFM127xh4/D5S4021 |
| 2707 | 9-14949-472 | 5q31.1–q31.2 | g1446/AFM127xh4/D5S4021 |
| 2708 | 9-15000-259 | 1q42.3–q43 | g427/AFMa111yd5/Z67285/ |
| 2717 | 9-15653-359 | Xp21.3–p21.2 | g3025/AFM292wb9/DXS1218/ |
| 2718 | 9-15654-122 | Xp21.3–p21.2 | g3025/AFM292wb9/DXS1218/ |

TABLE 9-continued

| SEQ ID No. | Marker Name | Chromosomal Localization | Adjacent STS (including aliases) |
|---|---|---|---|
| 2721 | 9-1591-235 | 1q43 | g1262/AFM088xe5/D1S2850 |
| | | | g17846/RH12368/stSG3536 |
| | | | g18893/RH34172/L18266/SHGC-4752 |
| | | | g307/WI-11654/RH50099/RH63795/R10130 |
| | | | g317/EST382595/RH49984/SGC34592 |
| | | | g402/D1S1680/G09467 |
| | | | g421/WI-12850/RH50542/Z41492 |
| | | | g4882/AFMa245wd5/D1S2678 |
| | | | g4901/AFMa247wg9/D1S2680/ |
| 2725 | 9-16026-359 | 5q31.3–q32 | g1166/AFM066xf11/D5S396 |
| | | | g20471/RH60098/WI-10312/ |
| 2726 | 9-1624-377 | 1q43 | g2259/AFM218zb6/D1S321/ |
| 2771 | 9-18122-403 | 20p12 | g1846/AFM197xb12/D20S112/ |
| 2772 | 9-18126-160 | 20p12 | g1846/AFM197xb12/D20S112/ |
| 2773 | 9-18127-283 | 20p12 | g1846/AFM197xb12/D20S112/ |
| 2774 | 9-18141-152 | 17p12 | g1854/AFM197xh6/D17S9221 |
| 2778 | 9-18334-485 | 2q35 | g11465/WI-11020/EST206594/WI-11020/RH56985/R36533 |
| | | | g24950/SHGC-6253/G02482 |
| | | | g891/EST165729/SGC33785/T95608 |
| | | | g892/RH56759/NIB1635/T16652 |
| | | | g893/WI-11020/EST206594/R36533 |
| | | | g894/WI-14333/EST228327/RH57030/R44333 |
| | | | g896/WI-22153/RH56193/ |
| 2784 | 9-18645-309 | 2q34–q35 | g2044/AFM205yb4/D2S295/ |
| 2785 | 9-18696-213 | 17q12 | g23714/RH55113/G04954/WI-5770/ |
| 2786 | 9-18698-346 | 11q23–q24 | g4760/AFMa222xc5/D11S4104/ |
| 2787 | 9-18710-208 | 17q23–q24 | g1684/AFM168xd12/D17S794/ |
| 2788 | 9-18717-319 | 17q23–q24 | g1684/AFM168xd12/D17S794/ |
| 2789 | 9-18718-362 | 17q23–q24 | g1684/AFM168xd12/D17S794/ |
| 2793 | 9-18944-242 | 6p21.2–p21.1 | g10052/AFM165YD12/ |
| 2794 | 9-19023-347 | 6p21.2–p21.1 | g10052/AFM165YD12/ |
| 2795 | 9-19027-222 | 6p21.2–p21.1 | g10052/AFM165YD12/ |
| 2796 | 9-19033-208 | 17p13 | g23660/RH54938/G05471/WI-9926/ |
| 2839 | 9-19324-214 | 5q32 | g11857/WI-12096/EST115160/WI-12096/RH59849/T61077 |
| | | | g20484/RH60414/H11651/SGC32445 |
| | | | g2482/AFM240xg3/D5S500 |
| | | | g653/WI-12096/T61077/ |
| 2840 | 9-19330-274 | 5q32 | g11857/WI-12096/EST115160/WI-12096/RH59849/T61077 |
| | | | g20484/RH60414/H11651/SGC32445 |
| | | | g2482/AFM240xg3/D5S500 |
| | | | 245 |
| | | | g653/WI-12096/T61077/ |
| 2946 | 9-20226-32 | 6p22.3 | g26006/SHGC-13860/T55234/ |
| 2947 | 9-20228-290 | 6p22.3 | g26006/SHGC-13860/T55234/ |
| 2948 | 9-20234-101 | 6p22.3 | g26006/SHGC-13860/T55234/ |
| 2953 | 9-20958-373 | 22q12.3–q13.1 | g24314/RH57665/T87617/WI-20641/ |
| 2954 | 9-21057-337 | 21q22.3 | g1183/AFM071xa1/D21S1912 |
| | | | g7874/D21S1851 |
| | | | g7918/D21S1930/ |
| 2955 | 9-21059-118 | 21q22.3 | g1183/AFM071xa1/D21S1912 |
| | | | g7874/D21S1851 |
| | | | g7918/D21S1930/ |
| 2961 | 9-21227-295 | 3p24.3–p25.1 | g24997/D3S4113/ |
| 3074 | 9-22202-58 | 11q22.3–q23.1 | g22439/RH51746/WI-14282/ |
| 3075 | 9-22204-391 | 11q22.3–q23.1 | g22439/RH51746/WI-14282/ |
| 3076 | 9-22206-455 | 11q22.3–q23.1 | g22439/RH51746/WI-14282/ |
| 3082 | 9-2251-151 | 21q22.1 | g7689/D21S1230/ |
| 3083 | 9-22530-48 | 6p22.1–p21.3 | g1070/AFM031yh12/D6S258/ |
| 3084 | 9-22537-280 | 6p22.1–p21.3 | g1070/AFM031yh12/D6S258/ |
| 3085 | 9-22567-243 | 14q24.3–q31 | g23143/RH53688/G04281/WI-3377 |
| | | | g27731/D14S929/ |
| 3086 | 9-22572-72 | 14q24.3–q31 | g23143/RH53688/G04281/WI-3377 |
| | | | g27731/D14S929/ |
| 3089 | 9-22729-352 | 2q35 | g19425/RH56275/H62242/SGC32398/RH56275/ |
| 3090 | 9-22768-113 | 2q35 | g24953/SHGC-971/Z17049 |
| | | | g4193/AFMa109wg5/D2S2151/ |
| 3091 | 9-22814-349 | 21q21.1 | g7005/D21S172 |
| | | | g7814/D21S1721E/ |
| 3092 | 9-22818-33 | 21q21.1 | g7005/D21S172 |
| | | | g7814/D21S1721E/ |
| 3093 | 9-22826-311 | 21q21.1 | g7005/D21S172 |
| | | | g7814/D21S1721E/ |

TABLE 9-continued

| SEQ ID No. | Marker Name | Chromosomal Localization | Adjacent STS (including aliases) |
|---|---|---|---|
| 3095 | 9-23113-388 | 22q12;2p23 | g19151/RH57021/R95095/SGC33508 g19152/RH56155/WI-10842/ |
| 3102 | 9-2333-423 | 21q22.1 | g7774/D21S1677 g7876/D21S1853 g7877/D21S1854 g7886/D21S1865 g7887/D21S1866/ |
| 3103 | 9-2341-485 | 21q22.1 | g7774/D21S1677 g7876/D21S1853 g7877/D21S1854 g7886/D21S1865 g7887/D21S1866/ |
| 3104 | 9-2342-217 | 21q22.1 | g7774/D21S1677 g7876/D21S1853 g7877/D21S1854 g7886/D21S1865 g7887/D21S1866/ |
| 3105 | 9-23427-283 | Xp11.22–p11.21 | g4806/AFMa230vc1/DXS8032/ |
| 3116 | 9-23696-164 | 5q31.2 | g1948/AFM200ya9/D5S414 g20384/AFM240yf6 g25905/SHGC-11406/T50434 g25906/SHGC-893/Z16886/ |
| 3117 | 9-23701-104 | 5q31.2 | g1948/AFM200ya9/D5S414 g20384/AFM240yf6 g25905/SHGC-11406/T50434 g25906/SHGC-893/Z16886/ |
| 3118 | 9-23702-437 | 5q31.2 | g1948/AFM200ya9/D5S414 g20384/AFM240yf6 g25905/SHGC-11406/T50434 g25906/SHGC-893/Z16886/ |
| 3119 | 9-2371-93 | 21q22.1 | g7798/D21S1700 g7879/D21S1856/ |
| 3120 | 9-23711-455 | 15q23 | g27865/D15S1242/ |
| 3121 | 9-23730-202 | 15q23 | g27865/D15S1242/ |
| 3188 | 9-24369-263 | 7q11.23–q21.1 | g11961/WI-12513/EST25131/RH61608/R74459/ |
| 3189 | 9-24397-315 | 11q22.3–q23.1 | g15763/WI-30893/RH52168/ |
| 3190 | 9-24408-202 | 14q24.3 | g23123/RH53961/T40920/SGC32981/SHGC-32981/ G27696/G25597/EST91724 g27725/SHGC-942/Z16981/RH49039/ |
| 3192 | 9-24412-279 | 1q24–q25 | g18536/RH26850/Z38322/ |
| 3193 | 9-24415-85 | 1q24–q25 | g18536/RH26850/Z38322/ |
| 3194 | 9-24470-168 | Xq22.2 | g24379/RH63325/G04441/WI-3796/ |
| 3195 | 9-24472-179 | Xq22.2 | g24379/RH63325/G04441/WI-3796/ |
| 3196 | 9-24480-44 | Xq22.2 | g24379/RH63325/G04441/WI-3796/ |
| 3197 | 9-24485-55 | Xp22.1 | g24364/RH63434/R59327/SGC31861/ |
| 3198 | 9-24490-363 | Xp22.1 | g24364/RH63434/R59327/SGC31861/ |
| 3199 | 9-24492-351 | Xp22.1 | g24364/RH63434/R59327/SGC31861/ |
| 3200 | 9-24581-253 | 22q11.2–q12 | g24283/RH57762/R54799/WI-21996 g24289/RH57833/G03738/WI-373/ |
| 3201 | 9-24591-33 | 22q11.2–q12 | g24283/RH57762/R54799/WI-21996 g24289/RH57833/G03738/WI-373/ |
| 3202 | 9-24592-55 | 4q26–q27 | g20097/RH59095/H50674/WI-18054/ |
| 3203 | 9-24745-413 | 11q23.1–q23.2 | g15768 g22459/RH52046/H86791/SGC31226/ |
| 3204 | 9-24753-182 | 11q23.1–q23.2 | g15768 g22459/RH52046/H86791/SGC31226/ |
| 3205 | 9-24768-233 | 22q13 | g775/stSG5976/RH27889/ |
| 3220 | 9-25362-247 | 17q12–q21 | g2174/AFM211zd12/D17S1842/ |
| 3223 | 9-25446-121 | 15q14 | g15961/WI-7216/RH54415/G06453/G00-679-062/ UTR-03037/M99564/ |
| 3224 | 9-25496-221 | 2q37.1 | g19470/RH56828/T54332/SGC33096 g24961/SHGC-1072/Z17274/RH13453/ |
| 3225 | 9-25497-242 | 21q22.2 g16433 | g16433 g24246/RH57580/SGC32448 g28577/SHGC-10474 g28580/SHGC-10477 g7818/D21S1725E/ |
| 3226 | 9-2559-253 | 21q22.3 g24258 | g24258/RH57551/R48588/SGC34143 g24259/RH57619/H53556/SGC34732/ |
| 3228 | 9-2566-112 | 21q22.3 g24258 | g24258/RH57551/R48588/SGC34143 g24259/RH57619/H53556/SGC34732/ |
| 3229 | 9-2567-329 | 21q22.3 g24258 | G24258/RH57551/R48588/SGC34143 g24259/RH57619/H53556/SGC34732/ |
| 3230 | 9-2571-242 | 21q22.3 g24258 | g24258/RH57551/R48588/SGC34143 g24259/RH57619/H53556/SGC34732/ |
| 3235 | 9-26051-273 | 10p12.1–p11.2 | g21912/RH51110/SGC31510/WICGR/ |

TABLE 9-continued

| SEQ ID No. | Marker Name | Chromosomal Localization | Adjacent STS (including aliases) |
|---|---|---|---|
| 3236 | 9-26058-275 | 19q13.1 g3203 | g3203/AFM304zg1/D19S417/ |
| 3237 | 9-26074-400 | 6p22 | g13490/WI-17546/EST261382/RH61086 g20682/RH60603/R26060/WI-11794/RH37391/ |
| 3238 | 9-26076-376 | 6p22 | g13490/WI-17546/EST261382/RH61086 g20682/RH60603/R26060/WI-11794/RH37391/ |
| 3239 | 9-2630-67 | 21q22.2 g16433 | g16433 g24246/RH57580/SGC32448 g28577/SHGC-10474 g28580/SHGC-10477 g7818/D21S1725E/ |
| 3240 | 9-2633-129 | 21q22.2 g16433 | g16433 g24246/RH57580/SGC32448 g28577/SHGC-10474 g28580/SHGC-10477 g7818/D21S1725E/ |
| 3241 | 9-2634-341 | 21q22.2 g16433 | g16433 g24246/RH57580/SGC32448 g28577/SRGC-10474 g28580/SHGC-10477 g7818/D21S1725E/ |
| 3242 | 9-2636-64 | 21q22.2 g16433 | g16433 g24246/RH57580/SGC32448 g28577/SHGC-10474 g28580/SHGC-10477 g7818/D21S1725E/ |
| 3243 | 9-2642-255 | 21q22.2 g16433 | g16433 g24246/RH57580/SGC32448 g28577/SRGC-10474 g28580/SRGC-10477 g7818/D21S1725E/ |
| 3244 | 9-2645-118 | 21q22.1 g2908 | g2908/AFM283xh9/D21S1255 g7915/D21S1928/ |
| 3245 | 9-2647-368 | 21q22.1 g2908 | g2908/AFM283xh9/D21S1255 g7915/D21S1928/ |
| 3246 | 9-2649-107 | 21q22.1 g2908 | g2908/AFM283xh9/D21S1255 g7915/D21S1928/ |
| 3493 | 9-4534-158 | 15q14–q15 | g15965/WI-11934/EST197813/RH54176/R27768 g15966/WI-19599/ |
| 3497 | 9-4589-169 | 1q43 | g314/WI-10464/ |
| 3502 | 9-468-271 | 10p11.2 g2598 | g2598/AFM254xb1/D10S224/ |
| 3527 | 9-4903-395 | 21q21.1 g7005 | g7005/D21S172 g7814/D21S1721E/ |
| 3528 | 9-499-294 | 10p12.1–p11.2 | g4171/AFMa106vf5/D10S1639/ |
| 3532 | 9-5098-29 | 7q11.23–q21.1 | g2935/AFM286xf9/D7S669/ |
| 3534 | 9-5112-188 | 7q11.23–q21.1 | g2935/AFM286xf9/D7S669/ |
| 3545 | 9-5549-289 | 2q33 | g675/RH18054/ |
| 3546 | 9-5569-237 | 2q33 | g675/RH18054/ |
| 3547 | 9-5575-330 | 2q34–q35 | g19417/RH56312/R44983/SGC31824 g646/RH56681/SGC33209/R02572 g647/D2S2635 g887/WI-10220/EST135001/T72644/ |
| 3548 | 9-5602-372 | 2q34–q35 | g19417/RH56312/R44983/SGC31824 g646/RH56681/SGC33209/R02572 g647/D2S2635 g887/WI-10220/EST135001/T72644/ |
| 3550 | 9-568-101 | 21q22.1–q22.2 | g2421/AFM238wc3/D21S267 g28563/SHGC-3796/Z17065/ |
| 3577 | 9-6401-64 | 9q34.2 | g2548/AFM248wf1/D9S179 g26813/SHGC-3659/Z17118/ |
| 3603 | 9-7117-266 | 10q25.3–q26.1 | g5771/AFMb320zb5/D10S1722/ |
| 3604 | 9-7203-286 | 1q43 | g12003/WI-12648/EST332992/RH49763/RH63832/R92197/ |
| 3617 | 9-7696-215 | 11q24 | g5443/AFMb066zg9/D11S4144/ |
| 3618 | 9-7702-225 | 11q24 | g5443/AFMb066zg9/D11S4144/ |
| 3619 | 9-7772-185 | 14q32.2 g27781 | g27781/SHGC-1408/Z23999/ |
| 3622 | 9-7860-320 | 2q34–q35 | g2794/AFM273va9/D2S334/ |
| 3623 | 9-7886-350 | 2q35 | g2211/AFM214ye1/D2S301/ |
| 3663 | 9-9316-399 | 2q34–q35 | g12748/WI-15052/EST283445/RH56222 g19413/AFMb299wb5/ |
| 3689 | 9-974-231 | 13q22.3–q31.1 | g2243/AFM218xd12/D13S264 g2474/AFM240wh2/D13S170/ |

TABLE 9-continued

| SEQ ID No. | Marker Name | Chromosomal Localization | Adjacent STS (including aliases) |
|---|---|---|---|
| 3782 | 9-13794-147 | 1q43 | g1262/AFM088xe5/D1S2850<br>g17846/RH12368/stSG3536<br>g18893/RH34172/L18266/SHGC-4752<br>g307/WI-11654/RH50099/RH63795/R10130<br>g317/EST382595/RH49984/SGC34592<br>g402/D1S1680/G09467<br>g421/WI-12850/RH50542/Z41492<br>g4882/AFMa245wd5/D1S2678<br>g4901/AFMa247wg9/D1S2680/ |
| 3788 | 9-19032-132 | 17p13 | g23660/RH54938/G05471/WI-9926/ |
| 3794 | 9-21051-435 | 21q22.3 g1183 | g1183/AFM071xa1/D21S1912<br>g7874/D21S1851<br>g7918/D21S1930/ |
| 3817 | 9-22679-148 | 18p11.31 | g23841/RH55516/G03618/WI-4219/ |
| 3818 | 9-23095-184 | 1q21–q22 | g17211/RH75/D19615/ |
| 3819 | 9-23370-249 | 2q35 | g16359/WI-19704/ |
| 3830 | 9-24267-190 | 2q33–q34 | g2141/AFM210yf10/D2S155/ |
| 3832 | 9-253-97 | 21q22.1 g24236 | g24236/RH57620/H16797/SGC32169<br>g2978/AFM289xh1/D21S1910/ |
| 3889 | 9-5605-90 | 2q34–q35 | g19417/RH56312/R44983/SGC31824<br>g646/RH56681/SGC33209/R02572<br>g647/D2S2635<br>g887/WI-10220/EST135001/T726441 |
| 3896 | 9-7215-279 | 8p21 | g12037/WI-12748/RH62389/G13379/HSC25C022/ |
| 3909 | 9-344-439 | 19q13.2–q13.3 | g448/RH11470/RH1669/ |
| 3910 | 9-366-274 | 19q13.2–q13.3 | g448/RH11470/RH1669/ |
| 3911 | 9-359-308 | 19q13.2–q13.3 | g448/RH11470/RH1669/ |
| 3912 | 9-355-219 | 19q13.2–q13.3 | g448/RH11470/RH1669/ |
| 3913 | 9-365-344 | 19q13.2–q13.3 | g448/RH11470/RH1669/ |

TABLE 10

| SEQ ID No. | Marker Name | Chromosomal Localization | Adjacent STS |
|---|---|---|---|
| 232 | 99-13647-278 | 11q12 | g403/WI-7199/RH49904/M30269<br>g406/AFM093XG5/Z66633<br>g416/D1S3481/G13394<br>g496/WI-20654/TWIK1/EST/RH50086/T89039/ |
| 233 | 99-13652-407 | 11q12 | g403/WI-7199/RH49904/M30269<br>g406/AFM093XGS/Z66633<br>g416/D1S3481/G13394<br>g496/WI-20654/TWIK1/EST/RH50086/T89039/ |
| 234 | 99-13663-218 | 11q12 | g403/WI-7199/RH49904/M30269<br>g406/AFM093XG5/Z66633<br>g416/D1S3481/G13394<br>g496/WI-20654/TWIK1/EST/RH50086/T89039/ |
| 235 | 99-13666-275 | 11q12 | g403/WI-7199/RH49904/M30269<br>g406/AFM093XGS/Z66633<br>g416/D1S3481/G13394<br>g496/WI-20654/TWIK1/EST/RH50086/T89039/ |
| 237 | 99-13671-396 | 11q12 | g403/WI-7199/RH49904/M30269<br>g406/AFM093XG5/Z66633<br>g416/D1S3481/G13394<br>g496/WI-20654/TWIK1/EST/RH50086/T89039/ |
| 322 | 99-1423-361 | 2p15-p14 | g411/AFMa045xa9/ |
| 326 | 99-1426-185 | 2p15-p14 | g411/AFMa045xa9/ |
| 517 | 99-15072-64 | 2q32-q33 | g27160/RH11834/ |
| 518 | 99-15087-77 | 2q32-q33 | g27160/RH11834/ |
| 550 | 99-1533-471 | 2p15-p14 | g411/AFMa045xa9/ |
| 555 | 99-1535-241 | 2p15-p14 | g411/AFMa045xa9/ |
| 556 | 99-1537-243 | 2p15-p14 | g411/AFMa045xa9/ |
| 592 | 99-15595-41 | 2q32.1-q32.2 | g313/D1S3401/G04332/ |
| 593 | 99-15596-64 | 2q32.1-q32.2 | g313/D1S3401/G04332/ |
| 594 | 99-15599-252 | 2q32.1-q32.2 | g313/D1S3401/G04332/ |
| 595 | 99-15605-221 | 2q32.1-q32.2 | g313/D1S3401/G04332/ |
| 596 | 99-15606-326 | 2q32.1-q32.2 | g313/D1S3401/G04332/ |
| 604 | 99-15705-110 | 15q23-q24 | g1484/AFM143xd12/D25128/ |
| 605 | 99-15717-120 | 15q23-q24 | g1484/AFM143xd12/D2S128/ |
| 606 | 99-15718-234 | 15q23-q24 | g1484/AFM143xd12/D2S128/ |
| 628 | 99-15891-215 | Xq26.3 | g8814/WI-14718/ |
| 699 | 99-16559-90 | | g2862/AFM278yd1/D6S444/ |
| 700 | 99-16562-182 | | g2862/AFM278yd1/D6S444/ |
| 701 | 99-16563-263 | | g2862/AFM278yd1/D6S444/ |
| 702 | 99-16564-118 | | g2862/AFM278yd1/D6S444/ |

TABLE 10-continued

| SEQ ID No. | Marker Name | Chromosomal Localization | Adjacent STS |
|---|---|---|---|
| 901 | 99-18085-94 | 3p23-p22 | g6189/AFMc013ye9/D4S3001/ |
| 902 | 99-18086-434 | 3p23-p22 | g6189/AFMc013ye9/D4S3001/ |
| 903 | 99-18087-152 | 3p23-p22 | g6189/AFMc013ye9/D4S3001/ |
| 923 | 99-18253-407 | | g22462/RH52139 g4351/AFMa130we1/D11S3178/ |
| 924 | 99-18255-259 | | g22462/RH52139 g4351/AFMa130we1/D11S3178/ |
| 929 | 99-18288-205 | | g4651/AFMa202zc1/D4S2923/ |
| 930 | 99-18289-36 | | g4651/AFMa202zc1/D4S2923/ |
| 932 | 99-18306-377 | | g10904/RH60078/ |
| 933 | 99-18307-371 | | g10904/RH60078/ |
| 934 | 99-18310-262 | | g10904/RH60078/ |
| 935 | 99-18312-58 | | g10904/RH60078/ |
| 964 | 99-18551-389 | | g1461/AFM136xd2/D5S403 g25942/SHGC-758/ |
| 967 | 99-18582-422 | | g10470/D5S1491 g22231/RH52188/ |
| 968 | 99-18588-175 | | g26653/SHGC-1005/Z17109 g3397/AFM324td5/D5S671/ |
| 969 | 99-18596-83 | | g26653/SHGC-1005/Z17109 g3397/AFM324td5/D5S671/ |
| 970 | 99-18597-415 | | g26653/SHGC-1005/Z17109 g3397/AFM324td5/D5S671/ |
| 971 | 99-18599-347 | | g26653/SHGC-1005/Z17109 g3397/AFM324td5/D5S671/ |
| 983 | 99-18666-483 | | g11811/WI-11885/ |
| 984 | 99-18667-392 | | g11811/WI-11885/ |
| 985 | 99-18669-223 | | g11811/WI-11885/ |
| 996 | 99-18751-217 | 1q22 | g8823/WI-4658/ |
| 997 | 99-18755-267 | 1q22 | g8823/WI-4658/ |
| 998 | 99-18774-69 | | g11451/D5S2428/10859/ |
| 999 | 99-18775-161 | | g11451/D5S2428/10859/ |
| 1000 | 99-18777-130 | | g11451/D5S2428/10859/ |
| 1001 | 99-18802-308 | | g13318/WI-16922/ |
| 1005 | 99-18822-368 | 6p21.1-p12 | g1552/AFM155ye1/D2S280/ |
| 1006 | 99-18826-378 | 6p21.1-p12 | g1552/AFM155ye1/D2S280/ |
| 1007 | 99-18827-92 | 6p21.1-p12 | g1552/AFM155ye1/D2S280/ |
| 1009 | 99-18847-263 | 6q24 | g2318/AFM224zf4/D2S161/ |
| 1010 | 99-18853-64 | | g13318/WI-16922/ |
| 1011 | 99-18855-173 | | g13318/WI-16922/ |
| 1012 | 99-18860-308 | | g13318/WI-16922/ |
| 1024 | 99-19008-237 | | g3339/AFM319zf9/D2S377/ |
| 1025 | 99-19013-384 | | g3339/AFM319zf9/D2S377/ |
| 1026 | 99-19016-51 | | g3339/AFM319zf9/D2S377/ |
| 1084 | 99-20348-403 | | g15529/WI-30719/RH64237/ |
| 1086 | 99-20353-229 | | g15529/WI-30719/RH64237/ |
| 1087 | 99-20357-359 | | g25667/SHGC-12669 g5998/AFMb349yf9/D4S2992/ |
| 1194 | 99-21141-314 | 6q23 | g1323/AFM105xc1/D2S318/105xc1/ |
| 1195 | 99-21148-269 | 6q23 | g1323/AFM105xc1/D2S318/105xc1/ |
| 1196 | 99-21149-129 | 6q23 | g1323/AFM105xc1/D2S318/105xc1/ |
| 1197 | 99-21167-159 | 6q23 | g1323/AFM105xc1/D2S318/105xc1/ |
| 1230 | 99-22160-331 | 13q22 | g17798/RH12008/ |
| 1231 | 99-22167-79 | 13q22 | g17798/RH12008/ |
| 1232 | 99-22172-304 | 13q22 | g17798/RH12008/ |
| 1234 | 99-22189-248 | 2q13-q14 | g1050/AFM026wh7/D12S1595/026wh7 g28792/SHGC-37555/ |
| 1236 | 99-22191-339 | 2q13-q14 | g1050/AFM026wh7/D12S1595/026wh7 g28792/SHGC-37555/ |
| 1237 | 99-22192-383 | 2q13-q14 | g1050/AFM026wh7/D12S1595/026wh7 g28792/SHGC-37555/ |
| 1241 | 99-22215-391 | 18p11.31 | g15435/D15S1203/WI-9767 g16860/WI-20135/ |
| 1242 | 99-22217-423 | 18p11.31 | g15435/D15S1203/WI-9767 g16860/WI-20135/ |
| 1244 | 99-22227-275 | 18p11.31 | g15435/D15S1203/WI-9767 g16860/WI-20135/ |
| 1247 | 99-22265-294 | 16 | g3692/AFMa041yb5/D16S3125/ |
| 1248 | 99-22266-474 | 16 | g3692/AFMa041yb5/D16S3125/ |
| 1251 | 99-22333-237 | | g4979/AFMa286ze9/D5S1994/ |
| 1252 | 99-22336-316 | | g4979/AFMa286ze9/D5S1994/ |
| 1253 | 99-22337-199 | | g4979/AFMa286ze9/D5S1994/ |
| 1255 | 99-22356-370 | | g11856/WI-12093/ |
| 1256 | 99-22357-186 | | g11856/WI-12093/ |
| 1258 | 99-22409-141 | | g11856/WI-12093/ |

TABLE 10-continued

| SEQ ID No. | Marker Name | Chromosomal Localization | Adjacent STS |
|---|---|---|---|
| 1267 | 99-22490-246 | 13q14.1 g16914 | WI-18828/ |
| 1268 | 99-22491-79 | 13q14.1 g16914 | WI-18828/ |
| 1270 | 99-22503-146 | 13q14.1 g16914 | WI-18828/ |
| 1271 | 99-22506-395 | 1p32.1-p31.3 | g20699/RH61218/ |
| 1272 | 99-22513-90 | 1p32.1-p31.3 | g20699/RH61218/ |
| 1273 | 99-22520-413 | 19q12-q13.1 | g18667/RH29813/ |
| 1307 | 99-22712-242 | 11q14-q21 | g10031/AFM115YB6/w1773 g19151/RH57021/R95095/SGC33508/ |
| 1308 | 99-22718-94 | 11q14-q21 | g10031/AFM115YB6/w1773 g19151/RH57021/R95095/SGC33508/ |
| 1310 | 99-22728-207 | 11q14-q21 | g10031/AFM115YB6/w1773 g19151/RH57021/R95095/SGC33508/ |
| 1322 | 99-22857-88 | 12q22 | g2972/AFM289vfS/D2S346/ |
| 1356 | 99-23266-146 | 5q13 | g12748/WI-15052/EST283445/RH56222/ |
| 1357 | 99-23269-263 | 5q13 | g12748/WI-15052/EST283445/RH56222/ |
| 1385 | 99-23469-288 | 14q31 | g20668/RH60581/ |
| 1387 | 99-23473-35 | 14q31 | g20668/RH60581/ |
| 1389 | 99-23488-239 | 2q32.3-q33 | g24198/RH57320/SGC30627/ |
| 1390 | 99-23492-151 | 2q32.3-q33 | g24198/RH57320/SGC30627/ |
| 1391 | 99-23496-94 | 2q32.3-q33 | g24198/RH57320/SGC30627/ |
| 1392 | 99-23510-45 | 8q21.1-q21.2 | g6072/AFMb359wh1/D11S4179/ |
| 1393 | 99-23528-452 | 8q21.1-q21.2 | g6072/AFMb359wh1/D11S4179/ |
| 1426 | 99-24381-217 | 4q34-q35 | g13574/WI-17820/ |
| 1427 | 99-24385-210 | 4q34-q35 | g13574/WI-17820/ |
| 1428 | 99-24388-391 | 4q34-q35 | g13574/WI-17820/ |
| 1437 | 99-24438-402 | 10p12-p11.2 | g15056/WI-7090 g18656/RH29333 g3307/AFM317yc5/D7S685/ |
| 1438 | 99-24441-431 | 10p12-p11.2 | g15056/WI-7090 g18656/RH29333 g3307/AFM317ycS/D7S685/ |
| 1459 | 99-25005-154 | 6p25 | g1147/AFM059yg5/D4S2988/059yg5/ |
| 1460 | 99-25007-131 | 6p25 | g1147/AFM059yg5/D4S2988/059yg5/ |
| 1465 | 99-25129-166 | | g6011/AFMb351xf9/D5S2050/ |
| 1466 | 99-25134-296 | | g6011/AFMb351xf9/D5S2050/ |
| 1473 | 99-25379-389 | | g2028/AFM205wh8/D5S417/ |
| 1474 | 99-25382-226 | | g2028/AFM205wh8/D5S417/ |
| 1475 | 99-25387-220 | | g2028/AFM205wh8/D5S417/ |
| 1476 | 99-25400-379 | | g25712/SHGC-1789 g25713/SHGC-6395 g2753/AFM268zd9/D5S630/ |
| 1477 | 99-25412-354 | | g11977/WI-12573 g13670/WI-18094/ |
| 1485 | 99-25458-103 | 14q31 | g13865/WI-18706/ |
| 1486 | 99-25503-333 | 5q22-q23.1 | g6127/AFMc003zg5/D3S3681/ |
| 1487 | 99-25507-373 | 15q15 | g19212/RH57152 g20451/RH59692/ |
| 1488 | 99-25510-390 | 15q15 | g19212/RH57152 g20451/RH59692/ |
| 1492 | 99-25575-303 | | g15433/D3S3958/WI-9747 g6236/AFMc024yd1/D3S3692/ |
| 1493 | 99-25618-196 | | g10319/AFMB346XE9/w2056 g4935/AFMa275zh1/D3S3588/ |
| 1494 | 99-25620-360 | | g10319/AFMB346XE9/w2056 g4935/AFMa275zh1/D3S3588/ |
| 1495 | 99-25629-262 | | g10319/AFMB346XE9/w2056 g4935/AFMa275zh1/D3S3588/ |
| 1496 | 99-25657-314 | | g5177/AFMa348yd9/D4S2955/ |
| 1497 | 99-25672-97 | | g10965/RH59124/ |
| 1498 | 99-25676-211 | | g10965/RH59124/ |
| 1499 | 99-25678-307 | | g10965/RH59124/ |
| 1501 | 99-25712-418 | | g11689/WI-11614 g13669/WI-18093/ |
| 1504 | 99-25725-80 | | g14391/D4S2653/WI-4583/ |
| 1505 | 99-25732-152 | | g14391/D4S2653/WI-4583/ |
| 1506 | 99-25745-36 | | g11645/WI-11521 g22536/RH52006/WI-6398/ |
| 1573 | 99-477-302 | 11q22.3-q23.1 | g5966/AFMb345ya9/D10S1732/ |
| 1577 | 99-482-130 | 11q22.3-q23.1 | g5966/AFMb345ya9/D10S1732/ |
| 1580 | 99-483-424 | 11q22.3-q23.1 | g5966/AFMb345ya9/D10S1732/ |
| 1585 | 99-486-243 | 11q22.3-q23.1 | g5966/AFMb345ya9/D10S1732/ |
| 1592 | 99-4924-254 | 3q13.3 | g1572/AFM157xg9/D2S2178/ |
| 1593 | 99-4928-102 | 3q13.3 | g1572/AFM157xg9/D2S2178/ |

TABLE 10-continued

| SEQ ID No. | Marker Name | Chromosomal Localization | Adjacent STS |
|---|---|---|---|
| 1778 | 99-6327-270 | 7q31.1 | g5753/AFMb319ze5/D4S2974/ |
| 1779 | 99-6332-143 | 7q31.1 | g5753/AFMb319ze5/D4S2974/ |
| 1786 | 99-6415-279 | 9q33 | g407/AFM151XB8/Z66679/ |
| 1787 | 99-6421-210 | 9q33 | g407/AFM151XB8/Z66679/ |
| 1788 | 99-6423-90 | 9q33 | g407/AFM151XB8/Z66679/ |
| 1789 | 99-6426-413 | 9q33 | g407/AFM151XB8/Z66679/ |
| 1790 | 99-6427-190 | 9q33 | g407/AFM151XB8/Z66679/ |
| 1800 | 99-6478-358 | 8q13 | g775/stSG5976/RH27889/ |
| 1801 | 99-6480-440 | 8q13 | g775/stSG5976/RH27889/ |
| 1802 | 99-6489-237 | 8q13 | g775/stSG5976/RH27889/ |
| 1887 | 99-7129-335 | 11q21 | g1453/AFM135xf12/D2S2396/ |
| 1888 | 99-7131-259 | 11q21 | g1453/AFM135xf12/D2S2396/ |
| 1889 | 99-7136-329 | 11q21 | g1453/AFM135xf12/D2S2396/ |
| 1890 | 99-7137-420 | 11q21 | g1453/AFM135xf12/D2S2396/ |
| 1891 | 99-7140-355 | 11q21 | g1453/AFM135xf12/D2S2396/ |
| 2104 | 99-8546-116 | 12q22 | g2972/AFM289vf5/D2S346/ |
| 2105 | 99-8571-396 | 12q15 | g1392/AFM119xc7/D2S126/ |
| 2106 | 99-8575-401 | 12q15 | g1392/AFM119xc7/D2S126/ |
| 2107 | 99-8576-321 | 12q15 | g1392/AFM119xc7/D2S126/ |
| 2108 | 99-8578-407 | 12q15 | g1392/AFM119xc7/D2S126/ |
| 2109 | 99-8581-443 | 12q15 | g1392/AFM119xc7/D2S126/ |
| 2190 | 99-913-140 | 7p22 | g2474/AFM240wh2/D13S170/ |
| 2709 | 99-15067-278 | 2q32-q33 | g27160/RH11834/ |
| 2716 | 99-15615-368 | 2q32.1-q32.2 | g313/D1S3401/G04332/ |
| 2729 | 99-16284-389 | Xq26.3 | g8814/WI-14718/ |
| 2776 | 99-18321-371 | | g2237/AFM217yel/D5S627 g4093/AFMa084zc1/D5S2113/ |
| 2782 | 99-18576-182 | | g10470/D5S1491 g22231/RH52188/ |
| 2783 | 99-18581-34 | | g10470/D5S1491 g22231/RH52188/ |
| 2790 | 99-18771-300 | | g11451/D5S2428/10859/ |
| 2956 | 99-21110-304 | | g3373/AFM323vc1/D11S1348/ |
| 2957 | 99-21123-62 | | g3373/AFM323vc1/D11S1348/ |
| 2958 | 99-21133-169 | | g3373/AFM323vc1/D11S1348/ |
| 3071 | 99-22181-171 | 4q23-q24 | g20693/RH61180/ |
| 3072 | 99-22187-261 | 13q13 | g15285/D1S3356/WI-8997 g19004/RH35464/ |
| 3073 | 99-22190-369 | 2q13-q14 | g1050/AFM026wh7/D12S1595/026wh7 g28792/SHGC-37555/ |
| 3077 | 99-22213-333 | 18p11.31 | g15435/D15S1203/WI-9767 g16860/WI-20135/ |
| 3078 | 99-22355-213 | | g11856/WI-12093/ |
| 3087 | 99-22593-64 | | g11914/WI-12390 g12081/WI-12941 g13404/WI-17166/ |
| 3088 | 99-22706-367 | 11q14-q21 | g10031/AFM115YB6/w1773 g19151/RH57021/R95095/SGC33508/ |
| 3094 | 99-22851-121 | 12q22 | g2972/AFM289vf5/D25346/ |
| 3096 | 99-23188-227 | 6p22.1-p21.3 | g19258/RH56674/ |
| 3097 | 99-23240-326 | 1q43;Xq25 | g18121/RH16765 g24533/RH63274/WI-9960 g28803/SHGC-16321 g495/WI-20605/RH50893/ |
| 3098 | 99-23246-66 | 6q27 | g1752/AFM184xb10/D8S1178/ |
| 3099 | 99-23248-308 | 6q27 | g1752/AFM184xb10/D8S1178/ |
| 3100 | 99-23249-262 | 6q27 | g1752/AFM184xb10/D8S1178/ |
| 3101 | 99-23274-182 | 2q33-q34 | g11967/WI-12530/ |
| 3219 | 99-25020-395 | 7q31.3 | g10580/D6S1053/ |
| 3221 | 99-25394-261 | | g25712/SHGC-1789 g25713/SHGC-6395 g2753/AFM268zd9/D5S630/ |
| 3222 | 99-25406-54 | | g11977/WI-12573 g13670/WI-18094/ |
| 3227 | 99-25654-281 | | g5177/AFMa348yd9/D4S2955/ |
| 3231 | 99-25738-218 | | g11645/WI-11521 g22536/RH52006/WI-6398/ |
| 3517 | 99-480-373 | 11q22.3-q23.1 | g5966/AFMb345ya9/D10S1732/ |
| 3575 | 99-6173-229 | 11q13.3;3q22;4p16;7p22;8p23.1 | g8817/WI-3139/ |
| 3620 | 99-7815-70 | | g316/EST47321/D19656/RH50110/SGC32758/ |
| 3621 | 99-7818-342 | 9q34.1 | g316/E5T47321/D19656/RH50110/SGC32758/ |
| 3816 | 99-22594-395 | 9q34.1 | g11914/WI-12390 g12081/WI-12941 g13404/WI-17166/ |

TABLE 11

| SEQ ID No | Marker Name | Localization |
|---|---|---|
| 1 | 99-109-224 | 8p23 |
| 4 | 99-1151-516 | 6p21.3–p21.2 |
| 10 | 99-1233-183 | 8p23 |
| 14 | 99-12503-44 | 8p23 |
| 15 | 99-12504-402 | 8p23 |
| 16 | 99-12505-374 | 8p23 |
| 17 | 99-12506-199 | 8p23 |
| 18 | 99-12509-423 | 8p23 |
| 19 | 99-12513-146 | 8p23 |
| 20 | 99-12514-170 | 8p23 |
| 21 | 99-12515-205 | 8p23 |
| 22 | 99-12516-524 | 8p23 |
| 23 | 99-12518-325 | 8p23 |
| 24 | 99-12523-255 | 8p23 |
| 25 | 99-12525-277 | 8p23 |
| 26 | 99-12526-317 | 8p23 |
| 27 | 99-12527-292 | 8p23 |
| 28 | 99-12531-30 | 8p23 |
| 29 | 99-12532-199 | 8p23 |
| 30 | 99-12534-207 | 8p23 |
| 31 | 99-12535-362 | 8p23 |
| 32 | 99-12537-340 | 8p23 |
| 33 | 99-12538-142 | 8p23 |
| 34 | 99-12539-287 | 8p23 |
| 35 | 99-12540-426 | 8p23 |
| 36 | 99-12541-307 | 8p23 |
| 37 | 99-12545-121 | 8p23 |
| 38 | 99-12548-88 | 8p23 |
| 39 | 99-12558-167 | 8p23 |
| 40 | 99-12562-291 | 8p23 |
| 41 | 99-12564-354 | 8p23 |
| 42 | 99-12565-273 | 8p23 |
| 43 | 99-12575-248 | 8p23 |
| 44 | 99-12576-325 | 8p23 |
| 45 | 99-12580-268 | 8p23 |
| 46 | 99-12585-85 | 8p23 |
| 47 | 99-12593-103 | 8p23 |
| 48 | 99-12600-283 | 8p23 |
| 49 | 99-12608-71 | 8p23 |
| 50 | 99-12610-106 | 8p23 |
| 51 | 99-12611-311 | 8p23 |
| 52 | 99-12613-366 | 8p23 |
| 53 | 99-12615-235 | 8p23 |
| 54 | 99-12617-412 | 8p23 |
| 55 | 99-12618-211 | 8p23 |
| 56 | 99-12619-367 | 8p23 |
| 57 | 99-12621-114 | 8p23 |
| 58 | 99-12624-61 | 8p23 |
| 60 | 99-12632-165 | 8p23 |
| 61 | 99-12637-62 | 8p23 |
| 62 | 99-12639-311 | 8p23 |
| 63 | 99-12640-179 | 8p23 |
| 64 | 99-12650-200 | 8p23 |
| 65 | 99-12651-297 | 8p23 |
| 66 | 99-12652-459 | 8p23 |
| 67 | 99-12654-278 | 8p23 |
| 68 | 99-12656-303 | 8p23 |
| 69 | 99-12658-206 | 8p23 |
| 70 | 99-12661-92 | 8p23 |
| 71 | 99-12668-329 | 8p23 |
| 72 | 99-1268-177 | 1q43 |
| 73 | 99-12733-366 | 8p23 |
| 74 | 99-12738-57 | 8p23 |
| 75 | 99-12740-354 | 8p23 |
| 76 | 99-12749-286 | 8p23 |
| 77 | 99-12750-369 | 8p23 |
| 78 | 99-12751-406 | 8p23 |
| 79 | 99-12755-421 | 8p23 |
| 80 | 99-12756-344 | 8p23 |
| 81 | 99-12757-240 | 8p23 |
| 82 | 99-12759-420 | 8p23 |
| 83 | 99-12777-71 | 8p23 |
| 84 | 99-12782-76 | 8p23 |
| 85 | 99-12794-299 | 8p23 |
| 86 | 99-128-60 | 8p23 |
| 87 | 99-12816-101 | 8p23 |
| 88 | 99-12817-358 | 8p23 |
| 89 | 99-12819-165 | 8p23 |
| 90 | 99-12826-408 | 8p23 |
| 91 | 99-12831-345 | 8p23 |
| 92 | 99-12836-387 | 8p23 |
| 93 | 99-12842-305 | 8p23 |
| 94 | 99-12843-337 | 8p23 |
| 95 | 99-12844-130 | 8p23 |
| 96 | 99-12847-37 | 8p23 |
| 97 | 99-12848-204 | 8p23 |
| 98 | 99-12852-260 | 8p23 |
| 99 | 99-12856-183 | 8p23 |
| 100 | 99-12878-291 | 8p23 |
| 101 | 99-12880-282 | 8p23 |
| 102 | 99-12884-248 | 8p23 |
| 103 | 99-12885-261 | 8p23 |
| 104 | 99-12898-364 | 8p23 |
| 105 | 99-12899-307 | 8p23 |
| 106 | 99-1290-291 | 1q43 |
| 107 | 99-12900-165 | 8p23 |
| 108 | 99-12901-316 | 8p23 |
| 109 | 99-12903-381 | 8p23 |
| 110 | 99-12907-295 | 8p23 |
| 111 | 99-12908-369 | 8p23 |
| 112 | 99-12913-197 | 8p23 |
| 113 | 99-12914-227 | 8p23 |
| 114 | 99-12924-273 | 8p23 |
| 115 | 99-12925-487 | 8p23 |
| 116 | 99-12926-332 | 8p23 |
| 117 | 99-12931-173 | 8p23 |
| 118 | 99-12948-61 | 8p23 |
| 119 | 99-12952-199 | 8p23 |
| 120 | 99-12956-43 | 8p23 |
| 121 | 99-12957-448 | 8p23 |
| 122 | 99-12961-318 | 8p23 |
| 123 | 99-12962-181 | 8p23 |
| 124 | 99-12963-255 | 8p23 |
| 125 | 99-12964-230 | 8p23 |
| 189 | 99-1342-51 | 1q43 |
| 195 | 99-1346-503 | 1q43 |
| 202 | 99-1351-264 | 1q43 |
| 214 | 99-1356-500 | 1q43 |
| 219 | 99-1359-355 | 8p23.2–23.1 |
| 228 | 99-1362-126 | 8p23.2–23.1 |
| 291 | 99-1404-135 | 1q43 |
| 341 | 99-14385-117 | 3q27 |
| 342 | 99-14392-431 | 3q27 |
| 343 | 99-14393-190 | 3q27 |
| 345 | 99-14405-105 | 3q27 |
| 358 | 99-14553-224 | 1q42.3 |
| 359 | 99-14562-402 | 1q42.3 |
| 360 | 99-14566-320 | 1q42.3 |
| 361 | 99-14574-310 | 1q42.3 |
| 362 | 99-14581-365 | 8p23 |
| 363 | 99-14591-172 | 8p23 |
| 364 | 99-14595-210 | 8p23 |
| 365 | 99-14596-174 | 8p23 |
| 366 | 99-14597-85 | 8p23 |
| 367 | 99-14598-91 | 8p23 |
| 368 | 99-14599-220 | 8p23 |
| 369 | 99-14600-207 | 8p23 |
| 370 | 99-14601-448 | 8p23 |
| 371 | 99-14607-267 | 8p23 |
| 372 | 99-14609-467 | 8p23 |
| 373 | 99-14610-351 | 8p23 |
| 374 | 99-14611-241 | 8p23 |
| 375 | 99-14612-100 | 8p23 |
| 376 | 99-14614-248 | 8p23 |
| 377 | 99-14615-65 | 8p23 |
| 378 | 99-14616-35 | 8p23 |
| 379 | 99-14618-147 | 8p23 |
| 380 | 99-14619-325 | 8p23 |
| 382 | 99-14620-253 | 8p23 |
| 383 | 99-14621-96 | 8p23 |
| 384 | 99-14622-276 | 8p23 |
| 385 | 99-14626-307 | 8p23 |
| 386 | 99-14627-272 | 8p23 |
| 387 | 99-14628-312 | 8p23 |

TABLE 11-continued

| SEQ ID No | Marker Name | Localization |
|---|---|---|
| 388 | 99-14629-274 | 8p23 |
| 389 | 99-14630-75 | 8p23 |
| 390 | 99-14634-350 | 8p23 |
| 391 | 99-14635-296 | 8p23 |
| 392 | 99-14637-366 | 8p23 |
| 393 | 99-14638-276 | 8p23 |
| 394 | 99-14643-27 | 8p23 |
| 395 | 99-14644-395 | 8p23 |
| 396 | 99-14647-227 | 8p23 |
| 397 | 99-14651-205 | 8p23 |
| 398 | 99-14652-120 | 8p23 |
| 399 | 99-14653-138 | 8p23 |
| 400 | 99-14622-352 | 8p23 |
| 401 | 99-14664-289 | 8p23 |
| 402 | 99-14665-199 | 8p23 |
| 403 | 99-14669-238 | 8p23 |
| 404 | 99-14671-175 | 8p23 |
| 405 | 99-14676-313 | 8p23 |
| 406 | 99-14677-358 | 8p23 |
| 407 | 99-14678-75 | 8p23 |
| 408 | 99-14679-241 | 8p23 |
| 411 | 99-14690-84 | 8p23 |
| 412 | 99-14692-46 | 8p23 |
| 413 | 99-14699-149 | 8p23 |
| 414 | 99-147-181 | 8p23.3–p23.2 |
| 415 | 99-14701-264 | 8p23 |
| 416 | 99-14704-59 | 8p23 |
| 417 | 99-14708-142 | 8p23 |
| 419 | 99-14710-107 | 8p23 |
| 420 | 99-14712-163 | 8p23 |
| 421 | 99-14714-237 | 8p23 |
| 422 | 99-14717-132 | 8p23 |
| 424 | 99-14722-272 | 8p23 |
| 425 | 99-14729-284 | 8p23 |
| 426 | 99-14733-26 | 8p23 |
| 427 | 99-14735-328 | 8p23 |
| 429 | 99-14746-377 | 8p23 |
| 430 | 99-14753-194 | 8p23 |
| 431 | 99-14756-270 | 8p23 |
| 433 | 99-14761-194 | 8p23 |
| 434 | 99-14773-383 | 8p23 |
| 435 | 99-14776-79 | 8p23 |
| 436 | 99-14777-100 | 8p23 |
| 437 | 99-14782-152 | 8p23 |
| 438 | 99-14784-212 | 8p23 |
| 439 | 99-14785-92 | 8p23 |
| 440 | 99-14786-59 | 8p23 |
| 441 | 99-1479-158 | 8p23 |
| 442 | 99-14792-43 | 8p23 |
| 443 | 99-14796-227 | 8p23 |
| 444 | 99-14799-57 | 8p23 |
| 445 | 99-148-182 | 8p23.3–p23.2 |
| 446 | 99-1480-290 | 8p23 |
| 447 | 99-14802-60 | 8p23 |
| 448 | 99-14803-157 | 8p23 |
| 449 | 99-14804-216 | 8p23 |
| 450 | 99-14805-58 | 8p23 |
| 451 | 99-14806-108 | 8p23 |
| 452 | 99-14807-150 | 8p23 |
| 453 | 99-1481-285 | 8p23 |
| 454 | 99-14810-407 | 8p23 |
| 455 | 99-14812-189 | 8p23 |
| 456 | 99-14817-323 | 8p23 |
| 457 | 99-14818-430 | 8p23 |
| 458 | 99-14819-278 | 8p23 |
| 459 | 99-14820-76 | 8p23 |
| 460 | 99-14821-48 | 8p23 |
| 461 | 99-14826-238 | 8p23 |
| 462 | 99-14828-214 | 8p23 |
| 463 | 99-14833-226 | 8p23 |
| 464 | 99-1484-328 | 8p23 |
| 465 | 99-14843-195 | 8p23 |
| 466 | 99-14844-143 | 8p23 |
| 467 | 99-1485-251 | 8p23 |
| 468 | 99-14850-136 | 8p23 |
| 469 | 99-14856-260 | 8p23 |
| 470 | 99-14861-387 | 8p23 |
| 471 | 99-14862-171 | 8p23 |
| 472 | 99-14865-386 | 8p23 |
| 473 | 99-14867-160 | 8p23 |
| 474 | 99-14872-326 | 8p23 |
| 475 | 99-14873-453 | 8p23 |
| 476 | 99-14875-411 | 8p23 |
| 477 | 99-14879-398 | 8p23 |
| 478 | 99-14881-231 | 8p23 |
| 479 | 99-14882-382 | 8p23 |
| 480 | 99-14883-123 | 8p23 |
| 481 | 99-1489-76 | 8p23 |
| 482 | 99-14890-358 | 8p23 |
| 483 | 99-14892-237 | 8p23 |
| 484 | 99-14894-52 | 8p23 |
| 485 | 99-14895-343 | 8p23 |
| 486 | 99-14897-356 | 8p23 |
| 487 | 99-1490-381 | 8p23 |
| 488 | 99-14907-411 | 8p23.1 |
| 489 | 99-1493-280 | 8p23 |
| 490 | 99-14937-42 | 11p15.1–p14 |
| 491 | 99-14939-240 | 11p15.1–p14 |
| 492 | 99-1494-598 | 8p23 |
| 493 | 99-14940-224 | 11p15.1–p14 |
| 501 | 99-1498-120 | 1q43 |
| 506 | 99-1501-296 | 1q43 |
| 513 | 99-1504-252 | 1q43 |
| 516 | 99-1506-505 | 1q43 |
| 519 | 99-15098-367 | 1q43 |
| 520 | 99-151-94 | 8p23.3–p23.2 |
| 521 | 99-15100-363 | 1q43 |
| 522 | 99-15101-154 | 1q43 |
| 523 | 99-15106-451 | 1q43 |
| 524 | 99-15107-228 | 1q43 |
| 525 | 99-15112-358 | 1q43 |
| 526 | 99-15118-69 | 1q43 |
| 527 | 99-15123-180 | 1q43 |
| 528 | 99-15128-349 | 1q43 |
| 529 | 99-15129-279 | 1q43 |
| 530 | 99-15135-231 | 1q43 |
| 531 | 99-15137-386 | 1q43 |
| 532 | 99-1515-402 | 1q43 |
| 533 | 99-15160-270 | 1q43 |
| 534 | 99-15164-67 | 1q43 |
| 538 | 99-1520-143 | 1q43 |
| 541 | 99-1521-457 | 1q43 |
| 542 | 99-1525-102 | 1q43 |
| 705 | 99-1658-474 | 1q43 |
| 707 | 99-1664-289 | 1q43 |
| 904 | 99-18091-47 | 14q24.2 |
| 905 | 99-18096-198 | 14q24.2 |
| 906 | 99-18109-159 | 6q24 |
| 919 | 99-18221-207 | 5q13 |
| 922 | 99-18242-369 | 5q13 |
| 925 | 99-18258-45 | 2q35 |
| 926 | 99-18268-460 | 2q35 |
| 927 | 99-18272-287 | 2q35 |
| 928 | 99-18276-390 | 2q35 |
| 965 | 99-18561-371 | 2q35 |
| 966 | 99-18573-363 | 2q35 |
| 1043 | 99-1997-139 | 8p23.2 |
| 1045 | 99-2000-240 | 8p23.2 |
| 1047 | 99-2001-177 | 8p23.2 |
| 1048 | 99-20011-229 | 3q21–q22 |
| 1049 | 99-20018-244 | 3q21–q22 |
| 1051 | 99-2003-509 | 8p23.2 |
| 1055 | 99-2004-35 | 8p23.2 |
| 1056 | 99-2005-466 | 8p23.2 |
| 1060 | 99-2007-278 | 8p23.2 |
| 1063 | 99-2010-363 | 8p23.2 |
| 1065 | 99-2012-243 | 8p23.2 |
| 1069 | 99-2020-281 | 8p23.2 |
| 1071 | 99-2022-200 | 8p23.2 |
| 1072 | 99-2024-132 | 8p23.2 |
| 1073 | 99-2025-234 | 8p23.2 |
| 1074 | 99-20250-362 | 4q21.1–q21.2 |
| 1075 | 99-2027-296 | 8p23.2 |
| 1085 | 99-2035-323 | 8p23.2 |

TABLE 11-continued

| SEQ ID No | Marker Name | Localization |
|---|---|---|
| 1088 | 99-2036-168 | 8p23.2 |
| 1089 | 99-2037-470 | 8p23.2 |
| 1091 | 99-2041-141 | 8p23.2 |
| 1092 | 99-2042-439 | 8p23.2 |
| 1093 | 99-20420-274 | 4p14 |
| 1094 | 99-20423-430 | 4p14 |
| 1095 | 99-20424-330 | 4p14 |
| 1096 | 99-20428-271 | 4p14 |
| 1097 | 99-2043-220 | 8p23.2 |
| 1098 | 99-2046-275 | 8p23.2 |
| 1100 | 99-2048-267 | 8p23.2 |
| 1108 | 99-2051-360 | 8p23.2 |
| 1112 | 99-2052-376 | 8p23.2 |
| 1114 | 99-2053-386 | 8p23.2 |
| 1116 | 99-2054-93 | 8p23.2 |
| 1119 | 99-2055-236 | 8p23.2 |
| 1121 | 99-2056-474 | 8p23.2 |
| 1127 | 99-2058-168 | 8p23.2 |
| 1130 | 99-2060-322 | 8p23.2 |
| 1131 | 99-2061-257 | 8p23 |
| 1134 | 99-2063-451 | 8p23 |
| 1149 | 99-2074-273 | 8p23 |
| 1154 | 99-2077-510 | 8p23 |
| 1156 | 99-2078-348 | 8p23 |
| 1159 | 99-2080-33 | 8p23 |
| 1162 | 99-2082-284 | 8p23 |
| 1166 | 99-2084-504 | 8p23 |
| 1167 | 99-2085-172 | 8p23 |
| 1175 | 99-2089-84 | 8p23 |
| 1177 | 99-2092-323 | 8p23 |
| 1179 | 99-2093-278 | 8p23 |
| 1181 | 99-2094-129 | 8p23 |
| 1183 | 99-2098-102 | 21q21 |
| 1186 | 99-2103-270 | 21q21 |
| 1187 | 99-21035-279 | 2q11.2 |
| 1188 | 99-21064-278 | 1q43 |
| 1189 | 99-21070-272 | 1q43 |
| 1190 | 99-21079-169 | 1q43 |
| 1191 | 99-21084-496 | 1q43 |
| 1192 | 99-2109-276 | 21q21 |
| 1193 | 99-211-291 | 8p23 |
| 1200 | 99-2126-79 | 8p23 |
| 1201 | 99-21370-87 | 22q11.2 |
| 1202 | 99-2170-188 | 8p23 |
| 1203 | 99-2172-314 | 8p23 |
| 1204 | 99-2173-289 | 8p23 |
| 1205 | 99-2179-303 | 8p23 |
| 1206 | 99-2193-225 | 8p23 |
| 1238 | 99-222-109 | 8p23 |
| 1277 | 99-22573-321 | 2q34–q35 |
| 1278 | 99-22578-78 | 2q34–q35 |
| 1279 | 99-22580-72 | 2q34–q35 |
| 1280 | 99-22585-462 | 2q34–q35 |
| 1281 | 99-22586-39 | 2q34–q35 |
| 1303 | 99-2269-179 | 21q22.1 |
| 1306 | 99-2271-403 | 21q22.1 |
| 1309 | 99-2272-409 | 21q22.1 |
| 1311 | 99-2273-528 | 21q22.1 |
| 1314 | 99-2275-466 | 21q22.1 |
| 1315 | 99-2276-331 | 21q22.1 |
| 1318 | 99-2278-276 | 21q22.1 |
| 1327 | 99-22937-395 | 14q24.2 |
| 1375 | 99-23437-347 | 2q34–q35 |
| 1376 | 99-23440-274 | 2q34–q35 |
| 1377 | 99-23444-203 | 2q34–q35 |
| 1379 | 99-23451-78 | 2q34–q35 |
| 1380 | 99-23452-306 | 2q34–q35 |
| 1381 | 99-23454-317 | 2q34–q35 |
| 1382 | 99-23460-199 | 2q34–q35 |
| 1402 | 99-23737-186 | 5q13 |
| 1404 | 99-23773-199 | 9q34.3 |
| 1407 | 99-2409-298 | 3 |
| 1408 | 99-241-341 | 21q21 |
| 1418 | 99-24275-107 | 2q33–q34 |
| 1432 | 99-2440-246 | 1q21.1–q21.2 |
| 1440 | 99-2445-79 | 1q21.1–q21.2 |
| 1452 | 99-24688-312 | 21q22.1 |
| 1464 | 99-25077-124 | 3p21.3 |
| 1489 | 99-25538-423 | 8p11.1–q11 |
| 1490 | 99-25539-86 | 8p11.1–q11 |
| 1491 | 99-25543-390 | 8p11.1–q11 |
| 1516 | 99-2610-121 | 21q22.1 |
| 1519 | 99-2615-83 | 21q22.1 |
| 1520 | 99-2620-227 | 21q22.1 |
| 1524 | 99-2662-407 | 1q43 |
| 1525 | 99-2669-233 | 1q43 |
| 1526 | 99-2675-121 | 1q43 |
| 1527 | 99-2683-388 | 1q43 |
| 1558 | 99-4666-185 | 8p23 |
| 1559 | 99-4674-166 | 8p23 |
| 1560 | 99-4676-342 | 8p23 |
| 1561 | 99-4677-58 | 8p23 |
| 1562 | 99-4679-240 | 8p23 |
| 1563 | 99-4680-352 | 8p23 |
| 1564 | 99-4681-228 | 8p23 |
| 1570 | 99-4725-251 | 1q23–q24 |
| 1596 | 99-4956-236 | 4q13.1–q13.2 |
| 1597 | 99-4966-298 | 4q13.1–q13.2 |
| 1598 | 99-4968-273 | 4q13.1–q13.2 |
| 1601 | 99-5032-232 | 4q31.3 |
| 1602 | 99-5036-40 | 2q12 |
| 1603 | 99-5038-181 | 2q12 |
| 1604 | 99-5043-111 | 2q12 |
| 1637 | 99-5326-332 | 3q25.1 |
| 1638 | 99-5338-151 | 6p12 |
| 1646 | 99-5389-409 | 1q43 |
| 1647 | 99-5390-375 | 1q43 |
| 1648 | 99-5401-280 | 1q43 |
| 1649 | 99-5405-376 | 1q43 |
| 1650 | 99-5406-299 | 1q43 |
| 1651 | 99-5407-173 | 1q43 |
| 1652 | 99-5411-378 | 1q43 |
| 1653 | 99-5416-137 | 1q43 |
| 1706 | 99-576-421 | 8p23 |
| 1712 | 99-582-132 | 8p23 |
| 1727 | 99-596-228 | 8p23 |
| 1730 | 99-598-130 | 8p23 |
| 1733 | 99-602-258 | 8p23 |
| 1739 | 99-607-397 | 8p23 |
| 1742 | 99-608-183 | 8p23 |
| 1744 | 99-609-225 | 8p23 |
| 1749 | 99-610-250 | 8p23 |
| 1755 | 99-614-346 | 8p23 |
| 1757 | 99-615-387 | 8p23 |
| 1758 | 99-616-338 | 8p23 |
| 1763 | 99-619-141 | 8p23 |
| 1766 | 99-621-215 | 8p23 |
| 1768 | 99-622-95 | 8p23 |
| 1791 | 99-6435-343 | 9q32 |
| 1792 | 99-6437-77 | 9q32 |
| 1793 | 99-6440-318 | 9q32 |
| 1794 | 99-6447-178 | 10q24.3–q25.1 |
| 1795 | 99-6456-165 | 10p15 |
| 1796 | 99-6459-201 | 10p15 |
| 1798 | 99-6463-348 | 10p15 |
| 1799 | 99-6468-288 | 10p15 |
| 1805 | 99-6511-176 | 10q26.3 |
| 1878 | 99-7084-187 | 10q26.2 |
| 1879 | 99-7090-294 | 10q26.2 |
| 1880 | 99-7093-36 | 10q26.2 |
| 1893 | 99-7144-261 | 1q43 |
| 1894 | 99-7148-262 | 1q43 |
| 1901 | 99-72-109 | 8p23 |
| 1912 | 99-73-140 | 8p23 |
| 1966 | 99-77-318 | 8p23 |
| 2032 | 99-81-227 | 8p23 |
| 2052 | 99-827-359 | 13 |
| 2057 | 99-828-259 | 13 |
| 2082 | 99-840-68 | 13 |
| 2099 | 99-851-237 | 13q31 |
| 2103 | 99-854-415 | 13q31 |
| 2113 | 99-860-419 | 13q31 |
| 2117 | 99-862-233 | 13q31 |
| 2126 | 99-866-160 | 13q31 |

TABLE 11-continued

| SEQ ID No | Marker Name | Localization |
|---|---|---|
| 2132 | 99-870-379 | 13q31 |
| 2146 | 99-88-216 | 8p23 |
| 2198 | 99-9240-109 | 2q33–q34 |
| 2199 | 99-9250-450 | 2q33–q34 |
| 2261 | 99-10000-518 | 4q25 |
| 2262 | 99-10016-115 | 4q21 |
| 2263 | 99-10027-378 | 4q25 |
| 2264 | 99-10028-93 | 4q25 |
| 2265 | 99-10031-130 | 4q25 |
| 2266 | 99-10046-199 | 4q25 |
| 2267 | 99-10064-252 | 4q25 |
| 2268 | 99-10066-465 | 4q25 |
| 2269 | 99-10067-168 | 4q25 |
| 2270 | 99-10078-341 | 4q25 |
| 2271 | 99-10104-464 | 4q21 |
| 2272 | 99-10106-247 | 4q21 |
| 2273 | 99-10108-419 | 4q21 |
| 2274 | 99-10118-323 | 4q25 |
| 2275 | 99-10126-413 | 4q25 |
| 2276 | 99-10127-506 | 4q25 |
| 2277 | 99-10137-195 | 4 |
| 2278 | 99-10142-293 | 4 |
| 2279 | 99-10143-111 | 4 |
| 2280 | 99-10146-202 | 4 |
| 2281 | 99-10149-291 | 4 |
| 2282 | 99-10151-340 | 4 |
| 2283 | 99-10153-267 | 4 |
| 2284 | 99-10155-423 | 4 |
| 2285 | 99-10173-122 | 4q25 |
| 2286 | 99-10179-48 | 4q25 |
| 2287 | 99-1018-244 | 16p13.1 |
| 2288 | 99-10183-166 | 4q25 |
| 2289 | 99-10185-402 | 4q25 |
| 2290 | 99-10188-116 | 4q25 |
| 2291 | 99-10201-115 | 4q25 |
| 2292 | 99-10207-173 | 4q25 |
| 2293 | 99-10211-380 | 4q25 |
| 2294 | 99-10216-336 | 4q25 |
| 2295 | 99-10220-312 | 4q25 |
| 2296 | 99-10223-153 | 4q25 |
| 2297 | 99-10224-223 | 4q25 |
| 2298 | 99-10234-334 | 4q25 |
| 2299 | 99-1024-403 | 16p13.1 |
| 2300 | 99-10245-197 | 5q |
| 2301 | 99-10256-41 | 5p |
| 2302 | 99-10264-82 | 5p |
| 2303 | 99-10266-290 | 5q |
| 2304 | 99-10267-409 | 5q |
| 2305 | 99-10303-406 | 5q31 |
| 2306 | 99-10304-88 | 5q31 |
| 2307 | 99-10312-155 | 5q |
| 2308 | 99-10318-230 | 6p22.2–22.3 |
| 2309 | 99-10330-432 | 6p22.2–22.3 |
| 2310 | 99-10332-89 | 6p22.2–22.3 |
| 2311 | 99-10345-182 | 6p24 |
| 2312 | 99-10353-285 | 6p24 |
| 2313 | 99-10364-331 | 6q21–22.1 |
| 2314 | 99-10369-41 | 6q21–22.1 |
| 2315 | 99-10374-343 | 6p22.3–24.3 |
| 2316 | 99-10381-328 | 6p22.1–22.3 |
| 2317 | 99-10389-114 | 6p22.1–22.3 |
| 2318 | 99-10390-172 | 6p22.3–24.1 |
| 2319 | 99-10414-128 | 6p22.3–24.1 |
| 2320 | 99-10434-121 | 6q27 |
| 2321 | 99-10436-162 | 6q27 |
| 2322 | 99-10438-281 | 6q27 |
| 2323 | 99-10446-425 | 6q21 |
| 2324 | 99-10451-188 | 6q21 |
| 2325 | 99-10452-306 | 6q21 |
| 2326 | 99-10457-310 | 6q21 |
| 2327 | 99-10470-405 | 6p25 |
| 2328 | 99-10471-88 | 6p25 |
| 2329 | 99-10473-259 | 6p25 |
| 2330 | 99-10474-223 | 6p25 |
| 2331 | 99-10481-217 | 6p22.3–23 |
| 2332 | 99-10487-57 | 6q16.1–16.3 |
| 2333 | 99-10488-146 | 6q16.1–16.3 |
| 2334 | 99-10491-300 | 6q16.1–16.3 |
| 2335 | 99-10499-102 | 6q27 |
| 2336 | 99-10502-161 | 6q27 |
| 2337 | 99-10506-307 | 6q27 |
| 2338 | 99-10507-216 | 6p23–25.1 |
| 2339 | 99-10509-122 | 6p23–25.1 |
| 2340 | 99-1051-284 | 16p13.1 |
| 2341 | 99-10513-347 | 6p23–25.1 |
| 2342 | 99-10514-546 | 6p23–25.1 |
| 2343 | 99-10521-296 | 6q16 |
| 2344 | 99-10522-395 | 6q16 |
| 2345 | 99-10536-90 | 6p22.3–23 |
| 2346 | 99-10539-208 | 6p22.3–23 |
| 2347 | 99-10542-326 | 6p22.3–23 |
| 2348 | 99-10543-278 | 6p22.3–23 |
| 2349 | 99-1055-140 | 16p13.1 |
| 2350 | 99-10557-276 | 6q23.1–23.3 |
| 2351 | 99-10567-233 | 6q22 |
| 2352 | 99-10570-107 | 6q22 |
| 2353 | 99-10573-375 | 6p21 |
| 2354 | 99-10575-416 | 6p21 |
| 2355 | 99-10576-351 | 6p21 |
| 2356 | 99-10577-36 | 6p21 |
| 2357 | 99-10581-354 | 6p21 |
| 2358 | 99-10589-360 | 6p21 |
| 2359 | 99-10601-463 | 6p21 |
| 2360 | 99-10606-92 | 6q27 |
| 2361 | 99-10608-353 | 6q27 |
| 2362 | 99-10613-277 | 6q27 |
| 2363 | 99-10618-404 | 6q27 |
| 2364 | 99-10626-196 | 6q22.2–22.33 |
| 2365 | 99-10630-236 | 6q22.2–22.33 |
| 2366 | 99-10632-55 | 6q21–22 |
| 2367 | 99-10634-141 | 6q21–22 |
| 2368 | 99-10643-161 | 6q21–22 |
| 2369 | 99-10659-208 | 6q26–q27 |
| 2370 | 99-10661-153 | 6q26–q27 |
| 2371 | 99-10662-397 | 6q26–q27 |
| 2372 | 99-10667-251 | 6q26–q27 |
| 2373 | 99-10675-109 | 6p24 |
| 2374 | 99-1068-309 | 16p11.2–p12 |
| 2375 | 99-10683-117 | 6p24 |
| 2376 | 99-10689-419 | 6p24 |
| 2377 | 99-10692-377 | 6q22 |
| 2378 | 99-10694-446 | 6q22 |
| 2379 | 99-10695-161 | 6q22 |
| 2380 | 99-1070-342 | 16p11.2–p12 |
| 2381 | 99-10702-261 | 6q22 |
| 2382 | 99-10706-228 | 6q16.1–21 |
| 2383 | 99-10708-28 | 6q16.1–21 |
| 2384 | 99-10709-460 | 6q16.1–21 |
| 2385 | 99-10715-43 | 6q16.1–21 |
| 2386 | 99-10719-455 | 6q22 |
| 2387 | 99-10720-63 | 6q22 |
| 2388 | 99-10731-195 | 6q22.1–6q22.33 |
| 2389 | 99-10735-238 | 6q22.1–6q22.33 |
| 2390 | 99-1074-127 | 16p13.11 |
| 2391 | 99-10741-421 | 6q22.1–6q22.33 |
| 2392 | 99-10743-315 | 6q22.1–6q22.33 |
| 2393 | 99-1075-314 | 16p13.11 |
| 2394 | 99-10752-366 | 7q31 |
| 2395 | 99-1076-116 | 16p13.11 |
| 2396 | 99-10769-291 | 7p15–p21 |
| 2397 | 99-10771-266 | 7p15–p21 |
| 2398 | 99-10775-331 | 7p15–p21 |
| 2399 | 99-10776-447 | 7p15–p21 |
| 2400 | 99-1079-237 | 16p13.11 |
| 2401 | 99-1081-159 | 16p13.11 |
| 2402 | 99-10816-272 | 7q21 |
| 2403 | 99-1082-180 | 16p13.11 |
| 2404 | 99-10839-239 | 7q31 |
| 2405 | 99-10842-232 | 7p15–p21 |
| 2406 | 99-10843-114 | 7p15–p21 |
| 2407 | 99-10856-246 | 7q31 |
| 2408 | 99-10861-96 | 7q31 |
| 2409 | 99-10862-397 | 7q31 |
| 2410 | 99-10864-418 | 7p21 |

TABLE 11-continued

| SEQ ID No | Marker Name | Localization |
|---|---|---|
| 2411 | 99-10870-234 | 7p21 |
| 2412 | 99-10874-69 | 7p21 |
| 2413 | 99-10879-386 | 7q21–q22 |
| 2414 | 99-10887-214 | 7q21–q22 |
| 2415 | 99-10890-201 | 7p15–p21 |
| 2416 | 99-10894-35 | 7p15–p21 |
| 2417 | 99-10898-209 | 7p15 |
| 2418 | 99-10904-111 | 7p15 |
| 2419 | 99-10905-85 | 7p15 |
| 2421 | 99-10927-388 | 7q11.2–q21 |
| 2422 | 99-10929-298 | 7q11.2–q21 |
| 2423 | 99-10930-95 | 7q11.2–q21 |
| 2424 | 99-10937-64 | 7q11.2–q21 |
| 2425 | 99-10944-83 | 7p15–p21 |
| 2426 | 99-10951-434 | 7p15–p21 |
| 2427 | 99-10959-113 | 7q21–q22 |
| 2428 | 99-10964-89 | 7q11.23–q21 |
| 2429 | 99-10965-174 | 7q11.23–q21 |
| 2430 | 99-10966-113 | 7q11.23–q21 |
| 2431 | 99-10974-193 | 7q11.23–q21 |
| 2432 | 99-10978-393 | 7q11.23–q21 |
| 2433 | 99-10979-156 | 7q11.23–q21 |
| 2434 | 99-10988-242 | 7q11.23–q21 |
| 2435 | 99-10992-98 | 7q31 |
| 2436 | 99-11000-163 | 7q31 |
| 2437 | 99-11001-393 | 7q31 |
| 2438 | 99-11003-361 | 7q31 |
| 2439 | 99-11006-426 | 7p15 |
| 2440 | 99-11007-68 | 7p15 |
| 2441 | 99-11014-194 | 7p15 |
| 2442 | 99-11034-317 | 7q11.23–q21.1 |
| 2443 | 99-11035-299 | 7q11.23–q21.1 |
| 2444 | 99-11037-218 | 7q11.23–q21.1 |
| 2446 | 99-11051-154 | 7q31 |
| 2447 | 99-11063-111 | 7q31 |
| 2448 | 99-11074-187 | 7q31 |
| 2449 | 99-11075-311 | 7q31 |
| 2450 | 99-11089-424 | 7p15–p21 |
| 2451 | 99-11094-427 | 7p15–p21 |
| 2452 | 99-11099-179 | 7p15–p21 |
| 2453 | 99-11103-88 | 7p15–p21 |
| 2454 | 99-11106-117 | 7p15–p21 |
| 2455 | 99-11110-375 | 7p15–p21 |
| 2456 | 99-11115-133 | 7p15–p21 |
| 2457 | 99-11119-132 | 8q21 |
| 2458 | 99-11128-162 | 8q21 |
| 2459 | 99-11136-374 | 8q21 |
| 2460 | 99-11142-139 | 8q21 |
| 2461 | 99-11143-443 | 8q21 |
| 2462 | 99-11144-137 | 8q21 |
| 2463 | 99-11148-369 | 11 |
| 2464 | 99-11158-255 | 11 |
| 2465 | 99-11163-293 | 11p11.2 |
| 2466 | 99-11164-298 | 11p11.2 |
| 2467 | 99-11168-197 | 11p11.2 |
| 2468 | 99-11175-348 | 11q25 |
| 2469 | 99-11179-239 | 11q25 |
| 2470 | 99-11180-148 | 11q25 |
| 2471 | 99-11183-166 | 11q25 |
| 2473 | 99-11210-235 | 11p14.3 |
| 2474 | 99-11214-188 | 11p14.3 |
| 2475 | 99-11218-174 | 11p14.3 |
| 2476 | 99-11236-63 | 11 |
| 2477 | 99-11247-86 | 11 |
| 2478 | 99-11248-404 | 11 |
| 2479 | 99-11252-263 | 11 |
| 2480 | 99-11255-375 | 12q24 |
| 2481 | 99-11260-422 | 12q24 |
| 2482 | 99-11261-255 | 12q24 |
| 2483 | 99-11293-125 | 12q |
| 2484 | 99-11313-95 | 15 |
| 2485 | 99-11320-29 | 15 |
| 2486 | 99-11326-356 | 16p11.2 |
| 2487 | 99-11340-89 | 16p11.2 |
| 2488 | 99-11346-222 | 16p11.2 |
| 2489 | 99-11350-116 | 16p11.2–p12 |
| 2490 | 99-11356-187 | 16p11.2–p12 |
| 2491 | 99-11362-334 | 16p11.2–p12 |
| 2492 | 99-11369-112 | 16p12–p13.1 |
| 2493 | 99-11372-162 | 16p12–p13.1 |
| 2494 | 99-11377-384 | 16p12–p13.1 |
| 2495 | 99-1381-256 | 16p12–p13.1 |
| 2496 | 99-11385-245 | 16p12.2–p12 |
| 2497 | 99-11413-239 | 16p11.2 |
| 2498 | 99-1143-340 | 6p21.3–p21.2 |
| 2499 | 99-11430-162 | 16p11.2 |
| 2500 | 99-11431-333 | 16p11.2 |
| 2501 | 99-11449-297 | 16p11.2 |
| 2502 | 99-11464-236 | 16p12.3 |
| 2503 | 99-11466-107 | 16p12.3 |
| 2504 | 99-11485-396 | 6p12 |
| 2505 | 99-11492-360 | 16p13.2–13.3 |
| 2506 | 99-11499-45 | 16p13.2–13.3 |
| 2507 | 99-11505-92 | 16p13.2–13.3 |
| 2508 | 99-11506-224 | 16p13.2–13.3 |
| 2509 | 99-11520-170 | 16p11.2–12 |
| 2510 | 99-11521-146 | 16p11.2–12 |
| 2511 | 99-11522-313 | 16p11.2–12 |
| 2512 | 99-11528-137 | 16p13.11 |
| 2513 | 99-11530-388 | 16p13.11 |
| 2514 | 99-11533-375 | 16p13.11 |
| 2515 | 99-11535-193 | 16p13.3 |
| 2516 | 99-11543-415 | 16p13.3 |
| 2517 | 99-11545-180 | 16p13.3 |
| 2518 | 99-11555-397 | 16p13.3 |
| 2519 | 99-11559-81 | 17 |
| 2520 | 99-11563-183 | 17 |
| 2521 | 99-11565-305 | 17 |
| 2522 | 99-11566-385 | 17 |
| 2523 | 99-11580-97 | 17 |
| 2524 | 99-11584-69 | 17 |
| 2525 | 99-11587-202 | 17 |
| 2526 | 99-11592-297 | 17 |
| 2527 | 99-11600-48 | 17 |
| 2528 | 99-11601-441 | 17 |
| 2529 | 99-11602-93 | 17 |
| 2530 | 99-11604-396 | 17 |
| 2531 | 99-11611-259 | 17 |
| 2532 | 99-11613-315 | 17 |
| 2533 | 99-11620-149 | 17 |
| 2534 | 99-11635-363 | 17 |
| 2535 | 99-11643-378 | 17 |
| 2536 | 99-11645-157 | 17 |
| 2537 | 99-11658-275 | 17 |
| 2538 | 99-11668-308 | 17 |
| 2539 | 99-11669-394 | 17 |
| 2540 | 99-11670-486 | 17 |
| 2541 | 99-11685-200 | 17 |
| 2542 | 99-11697-345 | 17 |
| 2543 | 99-11700-326 | 17 |
| 2544 | 99-11704-23 | 17 |
| 2545 | 99-11705-302 | 17 |
| 2546 | 99-11723-211 | 17 |
| 2547 | 99-11743-233 | 17 |
| 2548 | 99-11745-256 | 17 |
| 2549 | 99-11746-238 | 17 |
| 2550 | 99-11780-292 | 17 |
| 2551 | 99-11785-167 | 17 |
| 2552 | 99-11786-98 | 17 |
| 2553 | 99-11787-281 | 17 |
| 2554 | 99-11788-69 | 17 |
| 2555 | 99-11789-348 | 17 |
| 2556 | 99-11797-147 | 17 |
| 2557 | 99-11810-289 | 17 |
| 2558 | 99-11811-158 | 17 |
| 2559 | 99-1182-310 | 17 |
| 2560 | 99-11823-118 | 17 |
| 2561 | 99-11824-90 | 17 |
| 2562 | 99-1183-182 | 6 |
| 2563 | 99-11830-334 | 17 |
| 2564 | 99-11831-321 | 17 |
| 2565 | 99-11839-223 | 17 |
| 2566 | 99-11842-197 | 17 |
| 2567 | 99-1185-317 | 6 |

TABLE 11-continued

| SEQ ID No | Marker Name | Localization |
|---|---|---|
| 2568 | 99-11851-45 | 17 |
| 2569 | 99-11857-368 | 22 |
| 2570 | 99-1186-249 | 6 |
| 2571 | 99-11861-254 | 22 |
| 2572 | 99-11877-237 | 22q12–13 |
| 2573 | 99-11880-90 | 22q12–13 |
| 2574 | 99-11882-120 | 22q12–13 |
| 2575 | 99-11894-470 | 22q12-qter |
| 2576 | 99-11917-129 | 22q11.2-qter |
| 2577 | 99-11922-206 | 22q11.2-qter |
| 2578 | 99-11930-395 | 22q12.1 |
| 2579 | 99-11966-288 | 22 |
| 2580 | 99-11989-233 | Xp22 |
| 2581 | 99-11993-468 | X |
| 2582 | 99-12000-355 | X |
| 2583 | 99-12005-282 | X |
| 2584 | 99-12017-203 | Xp22 |
| 2586 | 99-12028-121 | Xp22 |
| 2588 | 99-12038-420 | X |
| 2589 | 99-12039-389 | X |
| 2590 | 99-12048-300 | X |
| 2591 | 99-12049-245 | X |
| 2592 | 99-12050-459 | X |
| 2593 | 99-12061-211 | X |
| 2594 | 99-12062-94 | X |
| 2595 | 99-12068-348 | X |
| 2596 | 99-12087-45 | X |
| 2598 | 99-12130-72 | X |
| 2599 | 99-12133-294 | X |
| 2600 | 99-12135-288 | X |
| 2601 | 99-12152-332 | X |
| 2602 | 99-12158-148 | X |
| 2603 | 99-12168-256 | X |
| 2604 | 99-12171-93 | X |
| 2605 | 99-12178-423 | X |
| 2606 | 99-12181-226 | X |
| 2607 | 99-12186-229 | X |
| 2608 | 99-12198-289 | X |
| 2609 | 99-12199-246 | X |
| 2610 | 99-12203-356 | X |
| 2611 | 99-12224-368 | Xq23 |
| 2612 | 99-12228-184 | Xq23 |
| 2613 | 99-12241-380 | Xq23 |
| 2614 | 99-12253-145 | Xq27–Xq28 |
| 2615 | 99-12265-324 | Xq21 |
| 2616 | 99-12267-161 | Xq21 |
| 2617 | 99-12268-54 | Xq21 |
| 2618 | 99-12270-408 | Xq21 |
| 2619 | 99-12271-298 | Xp11.3–p11.4 |
| 2620 | 99-12275-214 | Xp11.3–p11.4 |
| 2621 | 99-12299-433 | X |
| 2622 | 99-12303-460 | X |
| 2623 | 99-12335-394 | Xq21.1–Xq21.3 |
| 2624 | 99-12338-83 | Xq21.1–Xq21.3 |
| 2625 | 99-12344-171 | Xq21.1–Xq21.3 |
| 2626 | 99-12347-490 | Xp11.23–11.4 |
| 2627 | 99-12348-74 | Xp11.23–11.4 |
| 2628 | 99-12352-124 | Xp11.23–11.4 |
| 2629 | 99-12356-272 | Xp11.23–11.4 |
| 2630 | 99-12361-88 | Xp11.4 |
| 2631 | 99-12368-335 | Xp11.4 |
| 2632 | 99-12370-67 | Xp11.4 |
| 2633 | 99-12384-135 | Xq21 |
| 2634 | 99-12388-466 | Xq21 |
| 2635 | 99-12393-326 | Xq21 |
| 2636 | 99-12399-180 | Xq21.1–21.33 |
| 2637 | 99-12412-381 | Xq22 |
| 2638 | 99-12415-509 | Xq22 |
| 2639 | 99-12444-400 | Xq21.1 |
| 2640 | 99-12465-227 | Xq28 |
| 2641 | 99-12468-236 | Xq28 |
| 2642 | 99-12470-288 | Xq28 |
| 2643 | 99-12522-196 | 8p23 |
| 2644 | 99-12561-278 | 8p23 |
| 2645 | 99-12570-265 | 8p23 |
| 2646 | 99-12595-313 | 8p23 |
| 2647 | 99-12596-334 | 8p23 |
| 2648 | 99-12598-191 | 8p23 |
| 2649 | 99-12602-212 | 8p23 |
| 2650 | 99-12605-365 | 8p23 |
| 2651 | 99-12607-384 | 8p23 |
| 2652 | 99-12664-222 | 8p23 |
| 2653 | 99-12696-116 | 8p23 |
| 2654 | 99-12960-443 | 8p23 |
| 2661 | 99-1311-59 | X |
| 2664 | 99-1326-203 | X |
| 2665 | 99-1333-123 | X |
| 2666 | 99-1335-195 | X |
| 2694 | 99-14410-373 | 19q13.1 |
| 2695 | 99-14413-383 | 19q13.1 |
| 2696 | 99-14415-106 | 19q13.1 |
| 2697 | 99-14424-353 | 19q13.1 |
| 2698 | 99-14473-243 | 5q31.2 |
| 2699 | 99-14476-377 | 5q31.2 |
| 2700 | 99-14481-386 | 5q31.2 |
| 2701 | 99-14489-415 | 5q31.2 |
| 2702 | 99-14673-334 | 8p23 |
| 2703 | 99-14705-290 | 8p23 |
| 2704 | 99-14739-205 | 8p23 |
| 2705 | 99-14743-418 | 8p23 |
| 2733 | 99-16422-240 | 15q14 |
| 2734 | 99-16428-275 | 15q14 |
| 2735 | 99-16430-358 | 15q14 |
| 2736 | 99-16432-114 | 15q14 |
| 2797 | 99-19040-395 | 1q42–43 |
| 2798 | 99-19041-87 | 1q42–43 |
| 2799 | 99-19048-487 | 1q42–43 |
| 2800 | 99-19050-251 | 1q42–43 |
| 2801 | 99-19053-241 | 1q24–25 |
| 2802 | 99-19055-264 | 1q24–25 |
| 2803 | 99-19059-347 | 1q24–25 |
| 2804 | 99-19069-44 | 1p35.1–p36.21 |
| 2805 | 99-19095-106 | 1q24 |
| 2806 | 99-19096-317 | 1q24 |
| 2807 | 99-19104-66 | 1q24.1–25.3 |
| 2808 | 99-19105-114 | 1q24.1–25.3 |
| 2809 | 99-19108-156 | 1q24.1–25.3 |
| 2810 | 99-19110-175 | 1q24–25 |
| 2811 | 99-19122-58 | 1q24–25 |
| 2812 | 99-19123-242 | 1q24 |
| 2813 | 99-19130-86 | 1q24 |
| 2814 | 99-19137-156 | 1q32.3.–41 |
| 2815 | 99-19142-245 | 1q32.3.–41 |
| 2816 | 99-19154-146 | 1q32.2–q41 |
| 2817 | 99-19155-75 | 1q32.2–q41 |
| 2818 | 99-19167-269 | 1p34.3–36.13 |
| 2819 | 99-19170-193 | 1p34.3–36.13 |
| 2820 | 99-19171-120 | 1p34.3–36.13 |
| 2821 | 99-19175-150 | 1p34.3–36.13 |
| 2822 | 99-19177-425 | 1q24.1–25.2 |
| 2823 | 99-19178-163 | 1q24.1–25.2 |
| 2824 | 99-19210-502 | 1q32.1–32.3 |
| 2825 | 99-19219-316 | 1q32.1–32.3 |
| 2826 | 99-19220-220 | 1p34.4–36.13 |
| 2827 | 99-19223-238 | 1p34.4–36.13 |
| 2828 | 99-19226-169 | 1p34.4–36.13 |
| 2829 | 99-19228-319 | 1p34.4–36.13 |
| 2830 | 99-19236-409 | 3p13–3p14.2 |
| 2831 | 99-19241-362 | 3p13–3p14.2 |
| 2832 | 99-19242-254 | 3p13–3p14.2 |
| 2833 | 99-19283-172 | 1q32.1–32.3 |
| 2834 | 99-19295-95 | 1 |
| 2835 | 99-19304-270 | 1p36.21–36.33 |
| 2836 | 99-19305-367 | 1p36.21–36.33 |
| 2837 | 99-19309-296 | 1p36.21–36.33 |
| 2838 | 99-19312-34 | 1q24.1–24.3 |
| 2841 | 99-19347-228 | 1q24 |
| 2842 | 99-19348-229 | 1q24 |
| 2843 | 99-19351-360 | 1q24 |
| 2844 | 99-19368-92 | 8q21 |
| 2845 | 99-19375-434 | 8q21 |
| 2846 | 99-19381-249 | 8q21 |
| 2847 | 99-19383-432 | 8q21 |
| 2848 | 99-19384-63 | 8q21 |

TABLE 11-continued

| SEQ ID No | Marker Name | Localization |
| --- | --- | --- |
| 2849 | 99-19418-61 | 7p14–p15 |
| 2850 | 99-19420-86 | 7p14–p15 |
| 2851 | 99-19426-250 | 7p14–p15 |
| 2852 | 99-19431-249 | 7p14–p15 |
| 2853 | 99-19438-261 | 7q31 |
| 2854 | 99-19442-48 | 7q31 |
| 2855 | 99-19444-350 | 7q31 |
| 2856 | 99-19450-440 | 7p15.3–p21 |
| 2857 | 99-19453-250 | 7p15.3–p21 |
| 2858 | 99-19457-182 | 7p15.3–p21 |
| 2859 | 99-19460-346 | 7p21–p22 |
| 2860 | 99-19461-282 | 7p21–p22 |
| 2861 | 99-19464-165 | 7p21–p22 |
| 2862 | 99-19466-406 | 7p21–p22 |
| 2863 | 99-19474-266 | 7p21–p22 |
| 2864 | 99-19475-113 | 7p21–p22 |
| 2865 | 99-19477-208 | 7p21–p22 |
| 2866 | 99-19504-468 | 7q31–q32 |
| 2867 | 99-19528-278 | 7p12–p14 |
| 2868 | 99-19529-118 | 7p12–p14 |
| 2869 | 99-19532-207 | 7p12–p14 |
| 2870 | 99-19538-272 | 7p21 |
| 2871 | 99-19544-329 | 7p21–p22 |
| 2872 | 99-19546-473 | 7p21–p22 |
| 2873 | 99-19550-397 | 7p21–p22 |
| 2874 | 99-19553-52 | 7p21 |
| 2875 | 99-19557-152 | 7p21 |
| 2876 | 99-19560-289 | 7p21 |
| 2877 | 99-19562-227 | 7p21 |
| 2878 | 99-19566-337 | 7q34–q36 |
| 2879 | 99-19568-273 | 7q34–q36 |
| 2880 | 99-19575-299 | 7p15–p21 |
| 2881 | 99-19578-307 | 7p15–p21 |
| 2882 | 99-19580-323 | 7p15–p21 |
| 2883 | 99-19584-352 | 7q21.1–q31.1 |
| 2884 | 99-19588-438 | 7q21.1–q31.1 |
| 2885 | 99-19589-118 | 7q21.1–q31.1 |
| 2886 | 99-19601-95 | 7q21 |
| 2887 | 99-19624-48 | 7q21–q31.1 |
| 2888 | 99-19634-149 | 7q21–q31.1 |
| 2889 | 99-19639-225 | 7q11.23–q21.1 |
| 2890 | 99-19645-339 | 7q11.23–q21.1 |
| 2891 | 99-19650-338 | 7q11 |
| 2892 | 99-19651-133 | 7q11 |
| 2893 | 99-19664-328 | 7p14–p15 |
| 2894 | 99-19673-125 | 7p21–p22 |
| 2895 | 99-19678-269 | 7p21–p22 |
| 2896 | 99-19685-39 | 7q21.2–q31.1 |
| 2897 | 99-19697-304 | 7q21 |
| 2898 | 99-19703-75 | 7q21 |
| 2899 | 99-19705-128 | 7q21 |
| 2900 | 99-19709-299 | 7p14–p15 |
| 2901 | 99-19711-169 | 7p14–p15 |
| 2902 | 99-19722-150 | 7p12–p14 |
| 2903 | 99-19731-244 | 7p12–p14 |
| 2904 | 99-19732-385 | 7p12–p14 |
| 2905 | 99-19736-62 | 7p12–p14 |
| 2906 | 99-19745-330 | 7q22–q31.1 |
| 2907 | 99-19749-158 | 7p11.2–p12 |
| 2908 | 99-19752-88 | 7p11.2–p12 |
| 2909 | 99-19753-300 | 7p11.2–p12 |
| 2910 | 99-19756-85 | 7p11.2–p12 |
| 2911 | 99-19764-177 | 7p14–p15 |
| 2912 | 99-19769-227 | 7p14–p15 |
| 2913 | 99-19780-179 | 7p14–p15 |
| 2914 | 99-19785-140 | 7p14–p15 |
| 2915 | 99-19790-398 | 7p12–p14 |
| 2916 | 99-19791-103 | 7p12–p14 |
| 2917 | 99-19795-199 | 7p12–p14 |
| 2918 | 99-19796-256 | 7p12–p14 |
| 2919 | 99-19807-396 | 7q31 |
| 2920 | 99-19813-55 | 7p14–p15 |
| 2921 | 99-19818-156 | 7p14–p15 |
| 2922 | 99-19826-285 | 7q21 |
| 2923 | 99-19839-223 | 7p15–p21 |
| 2924 | 99-19851-40 | 7q31 |
| 2925 | 99-19858-91 | 7p12–p14 |
| 2926 | 99-19860-68 | 7p12–p14 |
| 2927 | 99-19864-112 | 7p12–p14 |
| 2928 | 99-19871-422 | 7p12–p14 |
| 2929 | 99-19872-136 | 7q31 |
| 2930 | 99-19875-99 | 7q31 |
| 2931 | 99-19876-394 | 7q31 |
| 2932 | 99-19890-235 | 7q11.23–q21.1 |
| 2933 | 99-19896-142 | 7p13–p14 |
| 2934 | 99-19901-383 | 7p13–p14 |
| 2935 | 99-19906-136 | 7p21 |
| 2936 | 99-19911-90 | 7p21 |
| 2937 | 99-19916-380 | 7p21 |
| 2938 | 99-19922-42 | 7q22–q31.1 |
| 2939 | 99-19923-383 | 7q22–q31.1 |
| 2940 | 99-19933-251 | 7p15–p21 |
| 2941 | 99-19937-235 | 7p15–p21 |
| 2942 | 99-19944-306 | 7q21–q22 |
| 2943 | 99-19951-313 | 7q21–q22 |
| 2959 | 99-21181-413 | 12q24 |
| 2960 | 99-21192-164 | 12q24 |
| 2962 | 99-21229-81 | Xq26.1–27.2 |
| 2963 | 99-21240-419 | 1q24 |
| 2964 | 99-21242-57 | 1q24 |
| 2965 | 99-21244-495 | 1q24 |
| 2966 | 99-21252-77 | Xp22.11–22.32 |
| 2967 | 99-21267-111 | Xq21.1–21.33 |
| 2969 | 99-21293-252 | 7p15–p21 |
| 2970 | 99-21307-370 | 5q31 |
| 2971 | 99-21310-416 | 5q31 |
| 2972 | 99-21312-319 | 5q31 |
| 2973 | 99-21323-142 | 16p12 |
| 2974 | 99-21327-94 | 4 |
| 2975 | 99-21328-173 | 4 |
| 2976 | 99-21329-518 | 4 |
| 2977 | 99-21342-350 | 7p15 |
| 2978 | 99-21346-290 | Xq23 |
| 2979 | 99-21360-343 | 22q11.2 |
| 2980 | 99-21361-97 | 22q11.2 |
| 2981 | 99-21377-73 | 22q11.2 |
| 2982 | 99-21378-303 | 22q11.2 |
| 2983 | 99-21391-418 | 22q11.2 |
| 2984 | 99-21401-117 | 22q11.2 |
| 2985 | 99-21423-302 | 22q11.2 |
| 2986 | 99-21433-238 | 22q11.2 |
| 2987 | 99-21441-420 | 22q11.2 |
| 2988 | 99-21444-227 | 22q11.2 |
| 2989 | 99-21448-361 | 22q11.2 |
| 2990 | 99-21461-375 | 22q12.1-qter |
| 2991 | 99-21463-258 | 22q12.1-qter |
| 2992 | 99-21465-58 | 22q12.1-qter |
| 2993 | 99-21486-88 | 17 |
| 2994 | 99-21492-310 | 17 |
| 2995 | 99-21502-211 | 17 |
| 2996 | 99-21508-131 | 17 |
| 2997 | 99-21510-466 | 17 |
| 2998 | 99-21512-165 | 17 |
| 2999 | 99-21516-293 | 17 |
| 3000 | 99-21533-445 | 17 |
| 3001 | 99-21560-376 | 19p12 |
| 3002 | 99-21561-41 | 19p12 |
| 3003 | 99-21566-152 | 19p12 |
| 3004 | 99-21578-105 | 17 |
| 3005 | 99-21580-141 | 17 |
| 3006 | 99-21591-181 | 22q11.2 |
| 3007 | 99-21592-43 | 22q11.2 |
| 3008 | 99-21607-114 | 22q11.2 |
| 3009 | 99-21615-133 | 22q11.2 |
| 3010 | 99-21657-161 | 17 |
| 3011 | 99-21664-278 | 17 |
| 3012 | 99-21666-96 | 17 |
| 3013 | 99-21673-106 | 17 |
| 3014 | 99-21674-245 | 17 |
| 3015 | 99-21687-313 | 21q22.2 |
| 3016 | 99-21690-162 | 21q22.2 |
| 3017 | 99-21693-368 | 21q22.2 |
| 3018 | 99-21699-149 | 21q22.2 |
| 3019 | 99-21703-36 | 21 |

TABLE 11-continued

| SEQ ID No | Marker Name | Localization |
|---|---|---|
| 3020 | 99-21705-306 | 21 |
| 3021 | 99-21707-429 | 21 |
| 3022 | 99-21710-272 | 21 |
| 3023 | 99-21733-323 | 21q22.3 |
| 3024 | 99-21734-183 | 21q22.3 |
| 3025 | 99-21742-337 | 21q22.3 |
| 3026 | 99-21745-455 | 21q22.3 |
| 3027 | 99-21756-230 | 21q22.3 |
| 3028 | 99-21759-21 | 21q22.3 |
| 3029 | 99-21762-135 | 21q22.3 |
| 3030 | 99-21763-52 | 21q22.3 |
| 3031 | 99-21765-111 | 22q11.2–12.2 |
| 3032 | 99-21767-392 | 22q11.2–12.2 |
| 3033 | 99-21771-144 | 22q11.2–12.2 |
| 3034 | 99-21775-466 | 22q12 |
| 3035 | 99-21787-348 | 22q12.1–12.3 |
| 3036 | 99-21790-161 | 22q12.1–12.3 |
| 3037 | 99-21791-364 | 22q12.1–12.3 |
| 3038 | 99-21800-310 | 22q11.2–12.1 |
| 3039 | 99-21801-123 | 22q11.2–12.1 |
| 3040 | 99-21804-310 | 22q11.2–12.1 |
| 3041 | 99-21810-222 | 22q11.2–12.1 |
| 3042 | 99-21811-209 | 22q13.31–13.32 |
| 3043 | 99-21827-155 | 22q13.31–13.32 |
| 3044 | 99-21829-261 | 22q13.31–33 |
| 3045 | 99-21831-311 | 22q13.31–33 |
| 3046 | 99-21838-153 | 22q13.31–33 |
| 3047 | 99-21844-165 | 22q12.1 |
| 3048 | 99-21846-327 | 22q12.1 |
| 3049 | 99-21874-311 | 20 |
| 3050 | 99-21880-331 | 20 |
| 3051 | 99-21881-152 | 20 |
| 3052 | 99-21889-219 | 20p12 |
| 3053 | 99-21893-388 | 20p12 |
| 3054 | 99-21896-345 | 20p12 |
| 3055 | 99-21898-102 | 20p12 |
| 3056 | 99-21901-331 | 20p12 |
| 3057 | 99-21913-483 | 20p12 |
| 3058 | 99-21916-359 | 22q12.1–12.3 |
| 3059 | 99-21917-84 | 22q12.1–12.3 |
| 3060 | 99-21919-38 | 22q12.1–12.3 |
| 3061 | 99-21921-338 | 22q12.1–12.3 |
| 3062 | 99-21943-413 | 20q12–13.12 |
| 3063 | 99-21948-237 | 20q12–13.12 |
| 3064 | 99-21950-107 | 20q12–13.12 |
| 3065 | 99-21952-76 | 20q12–13.2 |
| 3066 | 99-21968-150 | 20q12–13.1 |
| 3067 | 99-21969-425 | 20q12–13.1 |
| 3079 | 99-22363-268 | X |
| 3080 | 99-22375-353 | X |
| 3081 | 99-22405-335 | 16p13.11 |
| 3106 | 99-23442-190 | 2q34–q35 |
| 3107 | 99-23544-340 | 10q25 |
| 3108 | 99-23549-78 | 10q25 |
| 3109 | 99-23558-98 | 10q25 |
| 3110 | 99-23565-252 | 10q25 |
| 3111 | 99-23589-198 | 10 |
| 3112 | 99-23590-205 | 10 |
| 3113 | 99-23621-189 | 10 |
| 3114 | 99-23641-159 | 10 |
| 3115 | 99-23652-244 | 10 |
| 3122 | 99-23736-314 | 5q13 |
| 3123 | 99-23813-476 | 12q13.1 |
| 3124 | 99-23821-176 | 12q13.1 |
| 3125 | 99-23844-382 | 12q24 |
| 3126 | 99-23858-51 | 12q13.1 |
| 3127 | 99-23860-146 | 12q13.1 |
| 3128 | 99-23876-265 | 2 |
| 3129 | 99-23878-400 | 2 |
| 3130 | 99-23880-268 | 2 |
| 3131 | 99-23887-103 | 12q24 |
| 3132 | 99-23889-342 | 12q24 |
| 3133 | 99-23894-339 | 12q13 |
| 3134 | 99-23895-40 | 12q13 |
| 3135 | 99-23902-103 | 12q24.1 |
| 3136 | 99-23912-116 | 12q24.1 |
| 3137 | 99-23915-69 | 12q24.1 |
| 3138 | 99-23918-179 | 12q24.1 |
| 3139 | 99-23934-353 | 12p13.3 |
| 3140 | 99-23936-216 | 12p13.3 |
| 3141 | 99-23938-414 | 12p13.3 |
| 3142 | 99-23943-245 | 12p13.3 |
| 3143 | 99-23960-298 | 12 |
| 3144 | 99-23965-360 | 12 |
| 3145 | 99-23977-141 | 13q12–13 |
| 3146 | 99-23987-115 | 13q12–13 |
| 3147 | 99-23988-441 | 13q12–13 |
| 3148 | 99-23995-407 | 4q25 |
| 3149 | 99-24000-316 | 4q25 |
| 3150 | 99-24003-172 | 4p16 |
| 3151 | 99-24004-200 | 4p16 |
| 3152 | 99-24007-362 | 4p16 |
| 3153 | 99-24020-379 | 4 |
| 3154 | 99-24038-103 | 4 |
| 3155 | 99-24063-363 | 4 |
| 3156 | 99-24073-384 | 4 |
| 3157 | 99-24075-45 | 4 |
| 3158 | 99-24079-268 | 4 |
| 3159 | 99-24084-110 | 4 |
| 3160 | 99-24092-209 | 4 |
| 3161 | 99-24096-386 | 4 |
| 3162 | 99-24105-247 | 4 |
| 3163 | 99-24113-332 | 4 |
| 3164 | 99-24117-169 | 4 |
| 3165 | 99-24119-368 | 4 |
| 3166 | 99-24123-125 | 4 |
| 3167 | 99-24140-394 | 4 |
| 3168 | 99-24148-332 | 4 |
| 3169 | 99-24152-268 | 4 |
| 3170 | 99-24155-271 | 4 |
| 3171 | 99-24156-107 | 4 |
| 3172 | 99-24167-85 | 4 |
| 3173 | 99-24175-218 | 4 |
| 3174 | 99-24180-390 | 4 |
| 3175 | 99-24182-326 | 4q25 |
| 3176 | 99-24185-446 | 4q25 |
| 3177 | 99-24187-142 | 4q25 |
| 3178 | 99-24190-231 | 4q25 |
| 3179 | 99-24202-433 | 4q25 |
| 3180 | 99-24204-486 | 4 |
| 3181 | 99-24208-292 | 4 |
| 3182 | 99-24210-111 | 4 |
| 3183 | 99-24217-206 | 4 |
| 3184 | 99-24225-439 | 4 |
| 3185 | 99-24228-386 | 4 |
| 3186 | 99-24232-419 | 4 |
| 3187 | 99-24234-352 | 4 |
| 3191 | 99-2441-512 | 1q21.1–q21.2 |
| 3206 | 99-24855-180 | 6q21 |
| 3207 | 99-24863-199 | 6q21 |
| 3208 | 99-24867-219 | 6q27 |
| 3209 | 99-24871-435 | 6q27 |
| 3210 | 99-24889-311 | 4 |
| 3211 | 99-24897-276 | 4q25 |
| 3212 | 99-24904-187 | 4q25 |
| 3213 | 99-24909-440 | 22q11.2 |
| 3214 | 99-24917-250 | 7q22–q31 |
| 3215 | 99-24930-299 | 17 |
| 3216 | 99-24936-332 | 17 |
| 3217 | 99-24965-416 | 11p15.5 |
| 3218 | 99-24966-423 | 11p15.5 |
| 3251 | 99-2726-364 | 21 |
| 3252 | 99-2734-400 | 21q22.2 |
| 3253 | 99-2740-351 | 17 |
| 3254 | 99-2752-213 | 17 |
| 3255 | 99-2760-182 | 21 |
| 3256 | 99-2761-223 | 21 |
| 3257 | 99-2765-279 | 21 |
| 3258 | 99-2790-217 | 21 |
| 3259 | 99-2797-399 | 21 |
| 3260 | 99-2816-62 | 21 |
| 3261 | 99-2817-88 | 21 |
| 3262 | 99-2819-108 | 21 |
| 3263 | 99-2820-199 | 21 |

TABLE 11-continued

| SEQ ID No | Marker Name | Localization |
|---|---|---|
| 3264 | 99-2832-152 | 21 |
| 3267 | 99-2881-61 | 22q12 |
| 3268 | 99-2895-47 | 7q21–7q22 |
| 3269 | 99-2903-265 | 7q21–7q22 |
| 3270 | 99-2906-80 | 7q21–7q22 |
| 3271 | 99-2914-48 | 7q21–7q22 |
| 3272 | 99-2922-171 | 7q21–7q22 |
| 3273 | 99-2924-183 | 7q21–7q22 |
| 3274 | 99-2926-184 | 7q21–7q22 |
| 3275 | 99-2928-52 | 7q21–7q22 |
| 3276 | 99-2938-83 | 7q31.2 |
| 3277 | 99-2943-230 | 13q12–13q13 |
| 3278 | 99-2944-351 | 13q12–13q13 |
| 3279 | 99-295-355 | 8 |
| 3280 | 99-2954-160 | 3p21.3 |
| 3281 | 99-2956-239 | 3p21.3 |
| 3282 | 99-2970-318 | 7q21–7q22 |
| 3283 | 99-2978-135 | 7q21–7q22 |
| 3284 | 99-2981-53 | 7q21–7q22 |
| 3285 | 99-2988-243 | 7q31–q32 |
| 3286 | 99-2989-345 | 7q31–q32 |
| 3287 | 99-2991-256 | 7q31–q32 |
| 3288 | 99-2995-168 | 7q31–q32 |
| 3289 | 99-2999-371 | 7q31–q32 |
| 3290 | 99-3013-250 | Xq23 |
| 3291 | 99-3018-50 | Xq23 |
| 3292 | 99-3019-316 | Xq23 |
| 3293 | 99-3020-369 | Xq23 |
| 3294 | 99-3021-290 | Xq23 |
| 3295 | 99-3044-216 | 5p15.2 |
| 3296 | 99-3045-108 | 5p15.2 |
| 3297 | 99-3046-91 | 5p15.2 |
| 3298 | 99-3047-395 | 5p15.2 |
| 3299 | 99-3058-420 | 7q22 |
| 3301 | 99-3061-369 | 7q22 |
| 3302 | 99-3106-272 | 7q22 |
| 3303 | 99-3108-156 | 7q22 |
| 3304 | 99-3109-402 | 7q22 |
| 3305 | 99-3110-321 | 7q22 |
| 3306 | 99-312-311 | 8q24 |
| 3307 | 99-3129-113 | 19 |
| 3308 | 99-3132-158 | 19 |
| 3309 | 99-3144-112 | 19 |
| 3310 | 99-3147-24 | 19 |
| 3311 | 99-3153-190 | 19 |
| 3312 | 99-3154-110 | 19 |
| 3313 | 99-3156-251 | 19 |
| 3314 | 99-3167-227 | 19 |
| 3315 | 99-3195-71 | 10q25-qter |
| 3316 | 99-3217-274 | Xp22.1 |
| 3317 | 99-3224-232 | Xp22.1 |
| 3318 | 99-3231-109 | Xp22.1 |
| 3319 | 99-3234-274 | Xp22.1 |
| 3320 | 99-325-226 | 8q24.3 |
| 3321 | 99-3266-193 | 4p16.3 |
| 3322 | 99-3276-195 | 22q11.2-qter |
| 3323 | 99-3279-337 | 4p16.3 |
| 3324 | 99-3293-300 | 4p16.3 |
| 3325 | 99-3296-101 | 4p16.3 |
| 3326 | 99-3299-211 | 4p16.3 |
| 3327 | 99-3305-272 | 22q11.2-qter |
| 3328 | 99-3335-53 | 4p16.3 |
| 3329 | 99-3337-294 | 4p16.3 |
| 3330 | 99-3342-103 | 4p16.3 |
| 3331 | 99-3347-226 | 22q11.2-qter |
| 3332 | 99-3349-124 | 22 |
| 3333 | 99-3353-350 | 22q11.2-qter |
| 3334 | 99-3356-345 | 22q11.2-qter |
| 3335 | 99-3368-277 | 4p16.3 |
| 3336 | 99-3373-253 | 4p16.3 |
| 3337 | 99-3374-274 | 4p16.3 |
| 3338 | 99-3385-197 | 16p13.3 |
| 3339 | 99-3390-328 | 16p13.3 |
| 3340 | 99-3391-160 | 16p13.3 |
| 3341 | 99-3393-245 | 22q11.2-qter |
| 3342 | 99-3398-196 | 4p16.3 |
| 3343 | 99-3399-449 | 4p16.3 |
| 3344 | 99-3400-83 | 4p16.3 |
| 3345 | 99-3414-112 | 22q11.2-qter |
| 3346 | 99-3415-215 | 22q11.2-qter |
| 3347 | 99-3426-270 | 4p16.3 |
| 3348 | 99-3428-366 | 4p16.3 |
| 3349 | 99-3445-239 | 22q11.2-qter |
| 3350 | 99-3453-138 | 22q11.2-qter |
| 3351 | 99-3460-337 | 22q12 |
| 3352 | 99-3462-117 | 13q12–13 |
| 3353 | 99-3468-272 | 13q12–13 |
| 3354 | 99-3469-313 | 13q12–13 |
| 3355 | 99-3473-309 | 13q12–13 |
| 3356 | 99-3474-272 | 13q12–13 |
| 3357 | 99-3478-199 | 22 |
| 3358 | 99-3479-293 | 22 |
| 3359 | 99-3482-225 | 22q11.2-qter |
| 3360 | 99-3483-252 | 22q11.2-qter |
| 3361 | 99-3485-245 | 22q11.2-qter |
| 3362 | 99-3511-130 | 4p16.3 |
| 3363 | 99-3519-374 | 13q12–13 |
| 3364 | 99-3522-210 | 13q12–13 |
| 3365 | 99-3523-270 | 13q12–13 |
| 3366 | 99-3524-403 | 13q12–13 |
| 3367 | 99-3542-336 | 13q12–13 |
| 3368 | 99-3556-129 | 13q12–13 |
| 3369 | 99-3563-121 | 22 |
| 3370 | 99-3580-122 | 22 |
| 3371 | 99-3588-188 | 22q12 |
| 3372 | 99-3589-203 | 22q12-qter |
| 3373 | 99-3596-147 | 22q12 |
| 3374 | 99-36-69 | 1q23 |
| 3375 | 99-3601-226 | 22q12 |
| 3376 | 99-3603-80 | 22q12 |
| 3377 | 99-3604-91 | 22q12 |
| 3378 | 99-3619-330 | 22q12 |
| 3379 | 99-3620-314 | 22q12 |
| 3380 | 99-3628-31 | 6p21.3 |
| 3381 | 99-3629-219 | 6p21.3 |
| 3382 | 99-3631-159 | 6p21.3 |
| 3383 | 99-3638-259 | 22 |
| 3384 | 99-3641-230 | 22 |
| 3385 | 99-3666-280 | 16p13.3 |
| 3386 | 99-3667-190 | 16p13.3 |
| 3387 | 99-3677-196 | 22q11.2-qter |
| 3388 | 99-3680-274 | 22q11.2-qter |
| 3389 | 99-3689-50 | 22q12 |
| 3390 | 99-3690-355 | 22q12 |
| 3391 | 99-3699-230 | 22q12 |
| 3392 | 99-3702-226 | 22q12 |
| 3393 | 99-3703-331 | 22q12 |
| 3394 | 99-3705-195 | X |
| 3395 | 99-3709-366 | X |
| 3396 | 99-3717-68 | 22 |
| 3397 | 99-3728-341 | 11 |
| 3398 | 99-3739-215 | 22 |
| 3399 | 99-3746-337 | 6p21.3 |
| 3400 | 99-3749-174 | 6p21.3 |
| 3401 | 99-3752-210 | 6p21.3 |
| 3402 | 99-3760-59 | 6q21 |
| 3403 | 99-3761-329 | 6q21 |
| 3404 | 99-3764-198 | 6q21 |
| 3405 | 99-3765-279 | 6q21 |
| 3407 | 99-3773-337 | 6p21.3 |
| 3408 | 99-3774-351 | 6p21.3 |
| 3409 | 99-3775-98 | 6p21.3 |
| 3410 | 99-3778-97 | 13q12–13 |
| 3411 | 99-3789-293 | 3q12–13 |
| 3412 | 99-3792-294 | 16p13.3 |
| 3413 | 99-3802-197 | 13q12–13 |
| 3414 | 99-3805-125 | 13q12–13 |
| 3415 | 99-3812-243 | 22 |
| 3416 | 99-3813-122 | 22 |
| 3417 | 99-3857-261 | 17q22–q24 |
| 3418 | 99-3862-153 | 17q22–q24 |
| 3419 | 99-3875-138 | 8p12–q11.2 |
| 3420 | 99-3888-309 | Xp21.2 |
| 3421 | 99-3893-108 | 12q13 |

TABLE 11-continued

| SEQ ID No | Marker Name | Localization |
|---|---|---|
| 3424 | 99-3953-77 | 19q13.2–13.3 |
| 3425 | 99-3954-362 | 19q13.2–13.3 |
| 3426 | 99-3978-146 | X |
| 3427 | 99-3981-156 | X |
| 3428 | 99-3992-185 | 17q21 |
| 3429 | 99-4001-330 | 20q13.2-qter |
| 3430 | 99-4009-232 | 4q11–22 |
| 3431 | 99-4025-300 | 12pter–p12 |
| 3432 | 99-4052-415 | 6p25–p24 |
| 3433 | 99-4064-346 | Xp21.3–p21.1 |
| 3434 | 99-4065-20 | 11p15.5 |
| 3435 | 99-4073-307 | 11p15.5 |
| 3436 | 99-4076-255 | 22q11 |
| 3437 | 99-4077-230 | 22q11 |
| 3438 | 99-4078-212 | 22q11 |
| 3439 | 99-4079-389 | 22q11 |
| 3440 | 99-4119-307 | 10 |
| 3441 | 99-4120-253 | 10 |
| 3442 | 99-4122-23 | 16p13.13–13.2 |
| 3443 | 99-4125-192 | 16p13.13–13.2 |
| 3445 | 99-4138-360 | 12q24-qter |
| 3446 | 99-4139-128 | 12q24-qter |
| 3447 | 99-4140-254 | 12q24-qter |
| 3448 | 99-4182-113 | 12p13 |
| 3449 | 99-4193-384 | 1 |
| 3450 | 99-4194-336 | 1 |
| 3451 | 99-4199-339 | 4q |
| 3452 | 99-4201-501 | 4q |
| 3453 | 99-4202-223 | 11p15 |
| 3454 | 99-4203-110 | 11p15 |
| 3455 | 99-4207-210 | 22q12 |
| 3456 | 99-4218-24 | 22q12 |
| 3457 | 99-4220-241 | 22q12 |
| 3458 | 99-4225-339 | X |
| 3459 | 99-4231-139 | 17p13.3 |
| 3460 | 99-4232-105 | 17p13.3 |
| 3461 | 99-4233-261 | 12p12–13 |
| 3462 | 99-4238-181 | Xp21.2 |
| 3463 | 99-4251-311 | 12p12–13 |
| 3466 | 99-4283-257 | 19q13.1 |
| 3467 | 99-4284-200 | 12p12–p13 |
| 3468 | 99-4285-370 | 12p12–p13 |
| 3469 | 99-4290-131 | 12p12–13 |
| 3470 | 99-4293-344 | 12p12–13 |
| 3471 | 99-4296-156 | 8q24 |
| 3472 | 99-4312-338 | 4q11–12 |
| 3473 | 99-4323-311 | 5q33.3–q34 |
| 3474 | 99-4325-87 | 11q24 |
| 3475 | 99-4332-136 | 3p14.2 |
| 3476 | 99-4335-371 | 3p14.2 |
| 3477 | 99-4336-171 | 3p14.2 |
| 3478 | 99-4337-369 | 3p14.2 |
| 3479 | 99-4339-180 | 3p14.2 |
| 3481 | 99-4364-360 | Xp22 |
| 3482 | 99-4398-167 | 13q12–13q13 |
| 3483 | 99-4399-228 | 13q12–13q13 |
| 3484 | 99-4404-384 | Xp22.1–22.2 |
| 3485 | 99-4406-115 | Xp22.1–22.2 |
| 3486 | 99-4435-203 | 12p13 |
| 3487 | 99-4448-174 | 16p13.11 |
| 3488 | 99-4455-357 | 16p13.11 |
| 3489 | 99-4458-59 | 16p13.11 |
| 3490 | 99-4467-39 | 16p13 |
| 3491 | 99-4468-130 | 16p13 |
| 3492 | 99-4483-333 | 12p15 |
| 3494 | 99-4567-424 | 19 |
| 3495 | 99-4575-226 | 19 |
| 3496 | 99-4580-296 | 19 |
| 3535 | 99-515-151 | 21q22 |
| 3540 | 99-5329-269 | 6p12 |
| 3541 | 99-5339-196 | 6p12 |
| 3542 | 99-5347-394 | 1q43 |
| 3543 | 99-5397-353 | 1q43 |
| 3602 | 99-7086-91 | 10q26.2 |
| 3638 | 99-824-359 | 13 |
| 3647 | 99-882-250 | 1q23 |
| 3648 | 99-887-344 | 1q23 |
| 3650 | 99-892-77 | 1q23 |
| 3653 | 99-896-83 | 1q23 |
| 3654 | 99-899-252 | 6 |
| 3662 | 99-9308-416 | 5q31.3 |
| 3669 | 99-9607-402 | 1 |
| 3670 | 99-9620-241 | 1 |
| 3671 | 99-9623-330 | 1 |
| 3672 | 99-9633-32 | 1 |
| 3673 | 99-9636-423 | 1 |
| 3674 | 99-9658-42 | 1p35.2–36.13 |
| 3675 | 99-9662-213 | 1p35.2–36.13 |
| 3676 | 99-9666-363 | 1p35.2–36.13 |
| 3677 | 99-9668-185 | 1p35.2–36.13 |
| 3678 | 99-9680-363 | 1q23–25 |
| 3679 | 99-9696-292 | 1q24 |
| 3680 | 99-9697-375 | 1q24 |
| 3681 | 99-9700-289 | 1q24 |
| 3682 | 99-9704-445 | 1q24 |
| 3683 | 99-9706-448 | 1q24 |
| 3684 | 99-9709-115 | 1q24 |
| 3685 | 99-9710-242 | 1q24 |
| 3686 | 99-9714-302 | 1p36.13–36.22 |
| 3687 | 99-9717-449 | 1p36.13–36.22 |
| 3688 | 99-9726-190 | 1p36.21 |
| 3690 | 99-9745-284 | 1q23–24 |
| 3691 | 99-9751-134 | 1q24–q25 |
| 3692 | 99-9765-237 | 1p36.12–36.13 |
| 3693 | 99-9774-392 | 1p36.12–36.13 |
| 3694 | 99-9778-360 | 1p36.12–36.13 |
| 3695 | 99-9781-174 | 1p36.12–36.13 |
| 3696 | 99-9785-141 | 1q23.1–24.3 |
| 3697 | 99-9810-257 | 1p36.2–36.3 |
| 3698 | 99-9811-369 | 1p36.2–36.3 |
| 3699 | 99-9820-483 | 1p36.2–36.3 |
| 3700 | 99-9822-257 | 1p36.2–36.3 |
| 3701 | 99-9829-367 | 1q24–1q25 |
| 3702 | 99-983-278 | 11 |
| 3703 | 99-9832-128 | 1q24–1q25 |
| 3704 | 99-9833-167 | 1q24–1q25 |
| 3705 | 99-9835-217 | 1q24–1q25 |
| 3706 | 99-9837-275 | 1q23–1q24 |
| 3707 | 99-9839-416 | 1q23–1q24 |
| 3708 | 99-9840-192 | 1q23–1q24 |
| 3709 | 99-9847-25 | 2q1 |
| 3710 | 99-9849-291 | 2q1 |
| 3711 | 99-9852-276 | 2q1 |
| 3712 | 99-9854-316 | 2q1 |
| 3713 | 99-9856-252 | 3 |
| 3714 | 99-9859-132 | 3 |
| 3715 | 99-9866-365 | 3 |
| 3716 | 99-990-356 | 11 |
| 3717 | 99-9906-280 | 4q25 |
| 3718 | 99-9908-423 | 4q25 |
| 3719 | 99-991-157 | 16p13.11 |
| 3720 | 99-9915-281 | 4q25 |
| 3721 | 99-9920-245 | 4q25 |
| 3722 | 99-9921-365 | 4q25 |
| 3723 | 99-9922-154 | 4q25 |
| 3724 | 99-9926-454 | 4q25 |
| 3725 | 99-9928-454 | 4q25 |
| 3726 | 99-9929-144 | 4q25 |
| 3727 | 99-9935-418 | 4q25 |
| 3728 | 99-9941-426 | 4q25 |
| 3729 | 99-995-251 | 16p13.11 |
| 3730 | 99-996-210 | 16p13 |
| 3731 | 99-9986-202 | 4q25 |
| 3732 | 99-9988-111 | 4q25 |
| 3733 | 99-9994-226 | 4q25 |
| 3734 | 99-9995-50 | 4q25 |
| 3735 | 99-10069-366 | 4q25 |
| 3736 | 99-10074-266 | 4q25 |
| 3737 | 99-10129-177 | 4q25 |
| 3738 | 99-10198-271 | 4q25 |
| 3739 | 99-10306-345 | 5q |
| 3740 | 99-10307-115 | 5q |
| 3741 | 99-10326-149 | 6p22.2–22.3 |
| 3742 | 99-10393-179 | 6p22.3–24.1 |

TABLE 11-continued

| SEQ ID No | Marker Name | Localization |
|---|---|---|
| 3743 | 99-10685-454 | 6p24 |
| 3744 | 99-10857-217 | 7q31 |
| 3745 | 99-10948-281 | 7p15–p21 |
| 3746 | 99-11104-329 | 7p15–p21 |
| 3747 | 99-11116-199 | 8q21 |
| 3748 | 99-11117-282 | 8q21 |
| 3749 | 99-11121-461 | 8q21 |
| 3750 | 99-11124-363 | 8q21 |
| 3751 | 99-11172-373 | 11p11.2 |
| 3752 | 99-11206-379 | 11p14.3 |
| 3753 | 99-11303-223 | 15 |
| 3754 | 99-11307-168 | 15 |
| 3755 | 99-11325-188 | 16p11.2 |
| 3756 | 99-11365-273 | 16p11.2–p12 |
| 3757 | 99-11389-268 | 6p12.2–p12 |
| 3758 | 99-11395-376 | 16p12.2–p12 |
| 3759 | 99-11500-50 | 16p13.2–13.3 |
| 3760 | 99-11571-88 | 17 |
| 3761 | 99-11710-452 | 17 |
| 3762 | 99-1173-208 | 17 |
| 3763 | 99-11735-215 | 17 |
| 3764 | 99-11864-218 | 22 |
| 3765 | 99-1187-293 | 6 |
| 3766 | 99-11872-228 | 22 |
| 3767 | 99-11878-212 | 22q12–13 |
| 3768 | 99-11905-202 | 22q12-qter |
| 3769 | 99-11932-48 | 22q12.1 |
| 3770 | 99-11964-158 | 22 |
| 3771 | 99-12164-412 | X |
| 3772 | 99-12227-278 | Xq23 |
| 3773 | 99-12417-447 | Xq22 |
| 3774 | 99-12459-119 | Xq28 |
| 3775 | 99-12521-212 | 8p23 |
| 3776 | 99-12569-95 | 8p23 |
| 3777 | 99-1298-430 | X |
| 3778 | 99-1315-105 | X |
| 3783 | 99-14899-215 | 8p23.1 |
| 3789 | 99-19212-369 | 1q32.1–32.3 |
| 3790 | 99-19273-219 | 1p36.1–36.2 |
| 3791 | 99-19279-356 | 1q32.1–32.3 |
| 3792 | 99-19541-172 | 7p21 |
| 3793 | 99-19552-214 | 7p21–p22 |
| 3795 | 99-21246-20 | 1q24 |
| 3796 | 99-21387-465 | 22q11.2 |
| 3797 | 99-21407-352 | 22q11.2 |
| 3798 | 99-21418-83 | 22q11.2 |
| 3799 | 99-21419-85 | 22q11.2 |
| 3800 | 99-21430-308 | 22q11.2 |
| 3801 | 99-21435-96 | 22q11.2 |
| 3802 | 99-21446-240 | 22q11.2 |
| 3803 | 99-21452-173 | 22q11.2 |
| 3804 | 99-21488-376 | 17 |
| 3805 | 99-21489-227 | 17 |
| 3806 | 99-21496-248 | 17 |
| 3807 | 99-21519-446 | 17 |
| 3808 | 99-21618-178 | 22q11.2 |
| 3809 | 99-21725-371 | 21q22.3 |
| 3810 | 99-21773-155 | 22q12 |
| 3811 | 99-21781-252 | 22q12 |
| 3812 | 99-21820-230 | 22q13.31–13.32 |
| 3813 | 99-21822-50 | 22q13.31–13.32 |
| 3814 | 99-21939-170 | 20q12–13.12 |
| 3815 | 99-22404-59 | 16p13.11 |
| 3820 | 99-23568-395 | 10 |
| 3821 | 99-23824-339 | 12q13.1 |
| 3822 | 99-23969-316 | 12 |
| 3823 | 99-24032-138 | 4 |
| 3824 | 99-24048-286 | 4 |
| 3825 | 99-24074-190 | 4 |
| 3826 | 99-24082-408 | 4 |
| 3827 | 99-24104-308 | 4 |
| 3828 | 99-24138-224 | 4 |
| 3829 | 99-24172-116 | 4 |
| 3831 | 99-24949-289 | 17 |
| 3833 | 99-2694-411 | 1q43 |
| 3834 | 99-2697-336 | 1q43 |
| 3836 | 99-2851-105 | 1p13.3 |
| 3837 | 99-2889-197 | 22q13 |
| 3838 | 99-3072-323 | 7q21–7q22 |
| 3839 | 99-3089-49 | 7q21–7q22 |
| 3840 | 99-3157-203 | 19 |
| 3841 | 99-3210-341 | Xp22.1 |
| 3842 | 99-3218-344 | Xp22.1 |
| 3843 | 99-3251-254 | 4p16.3 |
| 3844 | 99-3298-158 | 4p16.3 |
| 3845 | 99-3300-433 | 22q11.2-qter |
| 3846 | 99-3364-247 | 22q11.2-qter |
| 3847 | 99-3427-271 | 4p16.3 |
| 3848 | 99-3484-96 | 22q11.2-qter |
| 3849 | 99-3537-196 | 22q12 |
| 3850 | 99-3568-156 | 22q12 |
| 3851 | 99-3592-325 | 22q12-qter |
| 3852 | 99-3602-245 | 22q12 |
| 3853 | 99-3608-264 | 22q11.2-qter |
| 3854 | 99-3643-352 | 9q34 |
| 3855 | 99-3770-363 | 6p21.3 |
| 3856 | 99-3772-266 | 6p21.3 |
| 3857 | 99-3790-361 | 13q12–13 |
| 3858 | 99-3818-255 | 22 |
| 3859 | 99-3863-328 | 7q22–q24 |
| 3860 | 99-3879-245 | 17q11.2 |
| 3861 | 99-3882-312 | 17q11.2 |
| 3862 | 99-3883-329 | 17q11.2 |
| 3863 | 99-3884-355 | 17q11.2 |
| 3864 | 99-3894-333 | 12q13 |
| 3865 | 99-3936-352 | Xq27.3–q28 |
| 3867 | 99-4029-174 | 12pter–p12 |
| 3869 | 99-4102-109 | 9q34 |
| 3870 | 99-4110-180 | 21q22.1 |
| 3871 | 99-4111-259 | 21q22.1 |
| 3872 | 99-4126-366 | 16p13.13–13.2 |
| 3873 | 99-4157-72 | 16p11.1 |
| 3874 | 99-4228-168 | 17p13.3 |
| 3875 | 99-4239-328 | Xp21.2 |
| 3876 | 99-4254-307 | 7q11.23 |
| 3878 | 99-4311-146 | 4q11–12 |
| 3879 | 99-4381-385 | Xq22.1–22.2 |
| 3880 | 99-4403-194 | Xp22.1–22.2 |
| 3881 | 99-4524-296 | 8 |
| 3882 | 99-4582-359 | 19 |
| 3899 | 99-889-153 | 1q23 |
| 3901 | 99-9609-220 | 1p36.2–36.3 |
| 3902 | 99-9612-324 | 1p36.2–36.3 |
| 3903 | 99-9616-136 | 1p36.2–36.3 |
| 3904 | 99-9683-49 | 1q23–25 |
| 3905 | 99-9907-88 | 4q25 |
| 3906 | 99-993-218 | 16p13.11 |
| 3907 | 99-24069-351 | 4 |
| 3908 | 99-3855-279 | 17q22–q24 |
| 3915 | 99-123-381 | 8p23 |
| 3916 | 4-26-29 | 8p23 |
| 3917 | 4-14-240 | 8p23 |
| 3918 | 4-77-151 | 8p23 |
| 3919 | 99-217-277 | 8p23 |
| 3920 | 4-67-40 | 8p23 |
| 3921 | 99-213-164 | 8p23 |
| 3922 | 99-221-377 | 8p23 |
| 3924 | 99-1482-32 | 8p23 |
| 3925 | 4-73-134 | 8p23 |
| 3926 | 4-65-324 | 8p23 |
| 3927 | 10-32-357 | 13q13 |
| 3928 | 10-33-175 | 13q13 |
| 3929 | 10-33-234 | 13q13 |
| 3930 | 10-33-327 | 13q13 |
| 3931 | 10-35-358 | 13q13 |
| 3932 | 10-35-390 | 13q13 |
| 3933 | 10-36-164 | 13q13 |
| 3934 | 10-204-326 | 13q13 |

SEQUENCE LISTING (11796 sequences)

SEQ ID NO: 1 - DNA, 47 bp, Homo Sapiens
  allele 24: 99-109-224 : polymorphic base G or C
ccacaggcttgattagaaataaastttgatcaccattttcaaatttt

SEQ ID NO: 2 - DNA, 47 bp, Homo Sapiens
  allele 24: 99-1126-384 : polymorphic base A or G
tagtgtttccattctaggtacccrccctacctccccagtgcccacag

SEQ ID NO: 3 - DNA, 47 bp, Homo Sapiens
  allele 24: 99-114-68 : polymorphic base G or C
tttgacttctgtttgtagatgaastggagttttgaaactgacactca

SEQ ID NO: 4 - DNA, 47 bp, Homo Sapiens
  allele 24: 99-1151-516 : polymorphic base A or C
taattgaagtggcagaatggtgamctggaatccaggtctaactcaag

SEQ ID NO: 5 - DNA, 47 bp, Homo Sapiens
  allele 24: 99-1165-159 : polymorphic base C or T
tagcctgtcttcaagctcactaaytttttcttctacttgatcagttc

SEQ ID NO: 6 - DNA, 47 bp, Homo Sapiens
  allele 24: 99-1167-201 : polymorphic base A or G
agatagtaatctaaagaaaactgrtttcccaaaactaacaaaataca

SEQ ID NO: 7 - DNA, 47 bp, Homo Sapiens
  allele 24: 99-117-205 : polymorphic base C or T
tgcatagaacaagacagtgaagtycttttgtgatctccattaaagta

SEQ ID NO: 8 - DNA, 47 bp, Homo Sapiens
  allele 24: 99-118-92 : polymorphic base C or T
cccacatttgtttgtatatctatytgtaagctgttgcttagaagaat

SEQ ID NO: 9 - DNA, 47 bp, Homo Sapiens
  allele 24: 99-1217-332 : polymorphic base C or T
cagagacctactttcgtgactagygtccggagggagggtagttttga

SEQ ID NO: 10 - DNA, 47 bp, Homo Sapiens
  allele 24: 99-1233-183 : polymorphic base A or G
ctatctagtcccaatttgtcaggrgctgaatgctactaaatggtttt

SEQ ID NO: 11 - DNA, 47 bp, Homo Sapiens
  allele 24: 99-12478-263 : polymorphic base G or T
taacccggaagatatgattcttakgcactctgagggctcctgatgta

SEQ ID NO: 12 - DNA, 47 bp, Homo Sapiens
  allele 24: 99-12487-301 : polymorphic base A or C
aagtgtgcagagacacgaacaagmttctccctgccaaggaattcact

SEQ ID NO: 13 - DNA, 47 bp, Homo Sapiens
  allele 24: 99-12497-155 : polymorphic base C or T
agtgcaacactgcactacttggaygaattcaggctaaagaggctcct

SEQ ID NO: 14 - DNA, 47 bp, Homo Sapiens
  allele 24: 99-12503-44 : polymorphic base G or C
gtctccctggtaagtcggttcttsttccagggaagcaaccctcagtc

SEQ ID NO: 15 - DNA, 47 bp, Homo Sapiens
  allele 24: 99-12504-402 : polymorphic base A or T
ggtaggctgagggagttacagccwgcactactcattcctgctggggc

SEQ ID NO: 16 - DNA, 47 bp, Homo Sapiens
  allele 24: 99-12505-374 : polymorphic base A or G
cagctggtgacagacaactcagcraggggagaccaggggcccagggc

SEQ ID NO: 17 - DNA, 47 bp, Homo Sapiens
  allele 24: 99-12506-199 : polymorphic base G or T
cctgagcccagtccagagccggckgcagaggccacagagccaactgt

SEQ ID NO: 18 - DNA, 47 bp, Homo Sapiens
  allele 24: 99-12509-423 : polymorphic base C or T
tcatgcaaagactggagttttgtygttactgaaatcagtctccctgg

SEQ ID NO: 19 - DNA, 47 bp, Homo Sapiens
  allele 24: 99-12513-146 : polymorphic base G or C
ccaaagaatggaagtcagtgttascaagtgtagagatttgggattgc

SEQ ID NO: 20 - DNA, 47 bp, Homo Sapiens
  allele 24: 99-12514-170 : polymorphic base G or C
aggtgtgagttgagcttatctagscaggtatattagccagtatgtga

SEQ ID NO: 21 - DNA, 47 bp, Homo Sapiens
  allele 24: 99-12515-205 : polymorphic base G or C
ccagaacagaacaaaggggcaccsacatgacagctcactaaatttct

SEQ ID NO: 22 - DNA, 47 bp, Homo Sapiens
  allele 24: 99-12516-524 : polymorphic base A or G
gccaaatacaagccaaggaatgarcagtgggttctgagtggggtttt

SEQ ID NO: 23 - DNA, 47 bp, Homo Sapiens
  allele 24: 99-12518-325 : polymorphic base C or T
ttgaaatcgagaaggtttatacayctttgttcttgattgttcttctc

SEQ ID NO: 24 - DNA, 47 bp, Homo Sapiens
  allele 24: 99-12523-255 : polymorphic base C or T
aggaaatgacacccgggatgaggytgtagagcagatgggggccaagt

SEQ ID NO: 25 - DNA, 47 bp, Homo Sapiens
  allele 24: 99-12525-277 : polymorphic base C or T
tggggcatggcgagaaggcgtgaygcacaaaccaagaagcgtccctc

SEQ ID NO: 26 - DNA, 47 bp, Homo Sapiens
  allele 24: 99-12526-317 : polymorphic base C or T
gatgtctggagacacttttgctgytgcagcttaggagggagcactat

SEQ ID NO: 27 - DNA, 47 bp, Homo Sapiens
  allele 24: 99-12527-292 : polymorphic base A or G
acacttggaataggatagcatttrtagtcatgaccaacctgtacccc

SEQ ID NO: 28 - DNA, 47 bp, Homo Sapiens
  allele 24: 99-12531-30 : polymorphic base C or T
gtggaggctgatttggaagaagaygtgagtggctgcagggagcccag

SEQ ID NO: 29 - DNA, 47 bp, Homo Sapiens
  allele 24: 99-12532-199 : polymorphic base A or T
gagaagctgcagaagctgagacawtcgatggttaccagctgtgtgtt

SEQ ID NO: 30 - DNA, 47 bp, Homo Sapiens
  allele 24: 99-12534-207 : polymorphic base A or C
gctcacactccttgaaggtgggcmcttcatctcaatcatctttggat

SEQ ID NO: 31 - DNA, 47 bp, Homo Sapiens
  allele 24: 99-12535-362 : polymorphic base A or C
ctttgaacaaaggctcaggtttcmggcttgaaaacagccttgctgga

SEQ ID NO: 32 - DNA, 47 bp, Homo Sapiens
  allele 24: 99-12537-340 : polymorphic base G or C
aaggtacaatgtgtggcccaagasaagctgcctgctctgcaaaagaa

SEQ ID NO: 33 - DNA, 47 bp, Homo Sapiens
  allele 24: 99-12538-142 : polymorphic base A or C
tcatagatttgctctgatctgagmtggttagtaacagggcacacggt

SEQ ID NO: 34 - DNA, 47 bp, Homo Sapiens
  allele 24: 99-12539-287 : polymorphic base C or T
gccttcctcctccctgatgtgcayaagggcagagctgtaaggtgaat

SEQ ID NO: 35 - DNA, 47 bp, Homo Sapiens
  allele 24: 99-12540-426 : polymorphic base C or T
agagaagtggggagcaccaggggycactaggattctgggtgctttga

SEQ ID NO: 36 - DNA, 47 bp, Homo Sapiens
  allele 24: 99-12541-307 : polymorphic base C or T
actataacatgtacacacccttaytattatttttgaaaaatgagata

SEQ ID NO: 37 - DNA, 47 bp, Homo Sapiens
  allele 24: 99-12545-121 : polymorphic base A or G
tggcagagagcttgagttgctccrcggccaaagaacccatgctcagt

SEQ ID NO: 38 - DNA, 47 bp, Homo Sapiens
  allele 24: 99-12548-88 : polymorphic base A or G
agagactaatgaacattggctctraactgatgctgattccaggagac

SEQ ID NO: 39 - DNA, 47 bp, Homo Sapiens
  allele 24: 99-12558-167 : polymorphic base C or T
gagcaggagtcatgcctttcttcyaaggaacatcctccagtgacttc

SEQ ID NO: 40 - DNA, 47 bp, Homo Sapiens
  allele 24: 99-12562-291 : polymorphic base C or T
accagaaccttggcagaaatcagyggtttaagcaaaaaatggtgcta

SEQ ID NO: 41 - DNA, 47 bp, Homo Sapiens
  allele 24: 99-12564-354 : polymorphic base A or T
ctgggagggtgaccggccaggtawcattacagtgaaagaccgtttcc

SEQ ID NO: 42 - DNA, 47 bp, Homo Sapiens
  allele 24: 99-12565-273 : polymorphic base C or T
tcagtaaacatagagtgcatccayatgaacgtttctgggtctcactt

SEQ ID NO: 43 - DNA, 47 bp, Homo Sapiens
  allele 24: 99-12575-248 : polymorphic base G or C
aaaggacttaagtgccaggtttgscttgtcctacaagtgctgttccc

SEQ ID NO: 44 - DNA, 47 bp, Homo Sapiens
  allele 24: 99-12576-325 : polymorphic base C or T
ggagtgtggcctggcccatgtggyggcctcaccagcagcacccggag

SEQ ID NO: 45 - DNA, 47 bp, Homo Sapiens
  allele 24: 99-12580-268 : polymorphic base A or G
gcaataaagagaaccagtgggatrgaggtcaccagggggaacttgtt

SEQ ID NO: 46 - DNA, 47 bp, Homo Sapiens
  allele 24: 99-12585-85 : polymorphic base A or C
aagcccagagagattgagtgactmatccaaggtctcccaggaattaa

SEQ ID NO: 47 - DNA, 47 bp, Homo Sapiens
  allele 24: 99-12593-103 : polymorphic base A or C
tccgtcctcatctgcccccttccmttggattgatggatacttctcag

SEQ ID NO: 48 - DNA, 47 bp, Homo Sapiens
  allele 24: 99-12600-283 : polymorphic base G or C
ttcataagtgatgttcagagatgsaggaattccaggtggtgcaggag

SEQ ID NO: 49 - DNA, 47 bp, Homo Sapiens
  allele 24: 99-12608-71 : polymorphic base C or T
atctctgaaagctataagtaatgyaaacaatttatatatcactctca

SEQ ID NO: 50 - DNA, 47 bp, Homo Sapiens
  allele 24: 99-12610-106 : polymorphic base C or T
gttcaccacttgccgctaagagcyggcaggaacccatatagacaagt

SEQ ID NO: 51 - DNA, 47 bp, Homo Sapiens
  allele 24: 99-12611-311 : polymorphic base G or T
taaatggctaaataaaaaatattkatataattcagtgaggcacagtt

SEQ ID NO: 52 - DNA, 47 bp, Homo Sapiens
  allele 24: 99-12613-366 : polymorphic base A or G
tcaaagagaggaagatgtgaaccrcaaactagccactggtccatagc

SEQ ID NO: 53 - DNA, 47 bp, Homo Sapiens
  allele 24: 99-12615-235 : polymorphic base A or C
gtgattcactagcttaaaaagccmtttccttggtaaagggtcactca

SEQ ID NO: 54 - DNA, 47 bp, Homo Sapiens
  allele 24: 99-12617-412 : polymorphic base G or C
cagcacctgggtggtcagcatatsagggaattcctgttaatgggtaa

SEQ ID NO: 55 - DNA, 47 bp, Homo Sapiens
  allele 24: 99-12618-211 : polymorphic base C or T
ggccacagaatcatttgattcttytcccccaggagcttgcaaattcc

SEQ ID NO: 56 - DNA, 47 bp, Homo Sapiens
  allele 24: 99-12619-367 : polymorphic base A or G
cacacctgtgtcagtttccaggcrtgacttcctggggctgacacaga

SEQ ID NO: 57 - DNA, 47 bp, Homo Sapiens
  allele 24: 99-12621-114 : polymorphic base A or G
gggtgtctgatcaactgaggtgcrtgatggtgagcaggaagtttgtg

SEQ ID NO: 58 - DNA, 47 bp, Homo Sapiens
  allele 24: 99-12624-61 : polymorphic base A or T
gttcaatagtgacagtttcatccwaggaactatatagcttagtgttt

SEQ ID NO: 59 - DNA, 47 bp, Homo Sapiens
  allele 24: 99-1263-276 : polymorphic base A or G
tggagataggagtccttatttaarctctcatgattagtggtaaaaat

SEQ ID NO: 60 - DNA, 47 bp, Homo Sapiens
  allele 24: 99-12632-165 : polymorphic base C or T
ggctttcaaaaccacaaatgcagyctctgaacttagactgatgatta

SEQ ID NO: 61 - DNA, 47 bp, Homo Sapiens
  allele 24: 99-12637-62 : polymorphic base C or T
gtaccaacacctgctttgttacaytgcaggcaatgaattggaaaatg

SEQ ID NO: 62 - DNA, 47 bp, Homo Sapiens
  allele 24: 99-12639-311 : polymorphic base G or C
gagtcacagttcacctggagtatsggctcgcatcatctcgacaatgg

SEQ ID NO: 63 - DNA, 47 bp, Homo Sapiens
  allele 24: 99-12640-179 : polymorphic base C or T
caaaaataactctccggtatgtaygtagttcactcacattttaaata

SEQ ID NO: 64 - DNA, 47 bp, Homo Sapiens
  allele 24: 99-12650-200 : polymorphic base C or T
tatgggaaatttcatcagagccaygtatatactaatctatgctactt

SEQ ID NO: 65 - DNA, 47 bp, Homo Sapiens
  allele 24: 99-12651-297 : polymorphic base G or C
tgtgcttgcaagcctggcgtcttsatgagatctcaacttcagcaccc

SEQ ID NO: 66 - DNA, 47 bp, Homo Sapiens
  allele 24: 99-12652-459 : polymorphic base A or G
agagaaactcacagcccttaaagraaactctgtggaaactgagacct

SEQ ID NO: 67 - DNA, 47 bp, Homo Sapiens
  allele 24: 99-12654-278 : polymorphic base G or T
ctcagatatgataaaatggttctktgaagctggtaagttttggggta

SEQ ID NO: 68 - DNA, 47 bp, Homo Sapiens
  allele 24: 99-12656-303 : polymorphic base C or T
cccccttcatgatggggctatcaycaggaagaccaagcaggtagata

SEQ ID NO: 69 - DNA, 47 bp, Homo Sapiens
  allele 24: 99-12658-206 : polymorphic base C or T
actagagtagccactaaacactgygatttatagtttaatttgatctg

SEQ ID NO: 70 - DNA, 47 bp, Homo Sapiens
  allele 24: 99-12661-92 : polymorphic base G or T
ttgtgatccaaataacatgttatkgtcaaaatgactttccagcaatg

SEQ ID NO: 71 - DNA, 47 bp, Homo Sapiens
  allele 24: 99-12668-329 : polymorphic base C or T
catcaccctcagcagatttcagtyctggtgacaaagaaattccaatt

SEQ ID NO: 72 - DNA, 47 bp, Homo Sapiens
  allele 24: 99-1268-177 : polymorphic base A or G
aatttgccactctgtgaatggccrtgaataaccgtgaaagctccatg

SEQ ID NO: 73 - DNA, 47 bp, Homo Sapiens
  allele 24: 99-12733-366 : polymorphic base G or C
tgcaggatctcagaatgacaacasacagacctacaggagaggtggag

SEQ ID NO: 74 - DNA, 47 bp, Homo Sapiens
  allele 24: 99-12738-57 : polymorphic base G or C
catgatggcagtcaggtatatcasacatatataaatgacacaaacag

SEQ ID NO: 75 - DNA, 47 bp, Homo Sapiens
  allele 24: 99-12740-354 : polymorphic base C or T
tgaaaaaccattctctttttaacyttcagttggcagattaacttcat

SEQ ID NO: 76 - DNA, 47 bp, Homo Sapiens
  allele 24: 99-12749-286 : polymorphic base A or G
taataaatgttttcaacacaatcrttaatgctttccagtgagttaaa

SEQ ID NO: 77 - DNA, 47 bp, Homo Sapiens
  allele 24: 99-12750-369 : polymorphic base A or T
aggaagtgtcatccagtgcaatawgggggaaaataaaatgtgcatag

SEQ ID NO: 78 - DNA, 47 bp, Homo Sapiens
  allele 24: 99-12751-406 : polymorphic base C or T
gttgcctcttgtctgaaatgaacytgattttaaccttttattttctg

SEQ ID NO: 79 - DNA, 47 bp, Homo Sapiens
  allele 24: 99-12755-421 : polymorphic base A or G
atttaaagtgagagtgtgtgctcrctcagctaaagccagggcaggag

SEQ ID NO: 80 - DNA, 47 bp, Homo Sapiens
  allele 24: 99-12756-344 : polymorphic base A or C
tattgtttccttggttattaatgmaattctcctactctcctgagaag

SEQ ID NO: 81 - DNA, 47 bp, Homo Sapiens
  allele 24: 99-12757-240 : polymorphic base A or G
ttggagcatcatagcttagctctrgccttccttaaatgtgctcggaa

SEQ ID NO: 82 - DNA, 47 bp, Homo Sapiens
  allele 24: 99-12759-420 : polymorphic base G or T
ggtgatggttcaccggcagtgtgkctctttctgtacgttggcttgct

SEQ ID NO: 83 - DNA, 47 bp, Homo Sapiens
  allele 24: 99-12777-71 : polymorphic base A or G
ccagagggtttccctgacacagcrggggatgctttgaggccccttta

SEQ ID NO: 84 - DNA, 47 bp, Homo Sapiens
  allele 24: 99-12782-76 : polymorphic base A or C
ttttcatctgggagcacctaaatmatgcctaatgaaatgaactttgg

SEQ ID NO: 85 - DNA, 47 bp, Homo Sapiens
  allele 24: 99-12794-299 : polymorphic base G or C
ctttaatcttagtggaccaacctstctcaaaagaaaaactacttcta

SEQ ID NO: 86 - DNA, 47 bp, Homo Sapiens
  allele 24: 99-128-60 : polymorphic base C or T
gcactgtgacccaggcgctaggtycctcttacagtgacactccgaca

SEQ ID NO: 87 - DNA, 47 bp, Homo Sapiens
  allele 24: 99-12816-101 : polymorphic base G or C
gttaagactaataggaattagaasaaagtgatgtacatcatctccag

SEQ ID NO: 88 - DNA, 47 bp, Homo Sapiens
  allele 24: 99-12817-358 : polymorphic base C or T
ccagagctgaattaatccagaatytatgtcttcctccgcctccggag

SEQ ID NO: 89 - DNA, 47 bp, Homo Sapiens
  allele 24: 99-12819-165 : polymorphic base A or G
tactacttcccagggcagagttcrtgtttttcgttcataaatggcct

SEQ ID NO: 90 - DNA, 47 bp, Homo Sapiens
  allele 24: 99-12826-408 : polymorphic base A or T
acgtgctgcaaccaaatacattawgtgtaaattgccaaagacctgtt

SEQ ID NO: 91 - DNA, 47 bp, Homo Sapiens
  allele 24: 99-12831-345 : polymorphic base A or C
atccccaaaaaggagcctgtgagmgtcagatgaagaatttaagaaat

SEQ ID NO: 92 - DNA, 47 bp, Homo Sapiens
  allele 24: 99-12836-387 : polymorphic base C or T
ccaggagacgggagcatggtactyaacacacttccatgcaccgttca

SEQ ID NO: 93 - DNA, 47 bp, Homo Sapiens
  allele 24: 99-12842-305 : polymorphic base C or T
agttggagggaacttccctaggtycggcagcataaaccagtgcctgt

SEQ ID NO: 94 - DNA, 47 bp, Homo Sapiens
  allele 24: 99-12843-337 : polymorphic base A or G
tttttgtcactcctgctactctgrccaaacctcgtatacttcaatca

SEQ ID NO: 95 - DNA, 47 bp, Homo Sapiens
  allele 24: 99-12844-130 : polymorphic base A or G
aaatcaaagtttctataagttgtrtagttctttccctgtgcatttta

SEQ ID NO: 96 - DNA, 47 bp, Homo Sapiens
  allele 24: 99-12847-37 : polymorphic base A or G
tctctggtttttctaaggtccacrggctgcagacatcgtttgtactt

SEQ ID NO: 97 - DNA, 47 bp, Homo Sapiens
  allele 24: 99-12848-204 : polymorphic base A or G
cagaattctgaaggcagtgtcacrgcacaaagaaactagctactgaa

SEQ ID NO: 98 - DNA, 47 bp, Homo Sapiens
  allele 24: 99-12852-260 : polymorphic base A or G
gttcacgaggaaatgggaactctractggacttccccacttgacttc

SEQ ID NO: 99 - DNA, 47 bp, Homo Sapiens
  allele 24: 99-12856-183 : polymorphic base A or C
tggggatcgttgcttttcttgttmcatatttctgcaggattgacttt

SEQ ID NO: 100 - DNA, 47 bp, Homo Sapiens
  allele 24: 99-12878-291 : polymorphic base C or T
gatagacaaagaggacaattaaayggaaggaacagttccttaggcat

SEQ ID NO: 101 - DNA, 47 bp, Homo Sapiens
  allele 24: 99-12880-282 : polymorphic base C or T
gggaaaagaagtgtggtgtatgcyaggccagtgcccccgaaccccca

SEQ ID NO: 102 - DNA, 47 bp, Homo Sapiens
  allele 24: 99-12884-248 : polymorphic base A or G
atagctttcatgcccgagaatggrgagagtcaatttgtgtttgggaa

SEQ ID NO: 103 - DNA, 47 bp, Homo Sapiens
  allele 24: 99-12885-261 : polymorphic base A or C
attccccactatctcaaggctctmctgaacccctcttaactttaccc

SEQ ID NO: 104 - DNA, 47 bp, Homo Sapiens
  allele 24: 99-12898-364 : polymorphic base C or T
taggagaaataacgtcgtgtagaytctgtaatacttgccaataggta

SEQ ID NO: 105 - DNA, 47 bp, Homo Sapiens
  allele 24: 99-12899-307 : polymorphic base C or T
attttaatcaaggaaaagggaggyaataggaaggagagaagaacaaa

SEQ ID NO: 106 - DNA, 47 bp, Homo Sapiens
  allele 24: 99-1290-291 : polymorphic base C or T
aaaggcagacagaactaggacacyggccattaattggtgatatccag

SEQ ID NO: 107 - DNA, 47 bp, Homo Sapiens
  allele 24: 99-12900-165 : polymorphic base G or C
gttacttacctatttttgcatttsaaaacagacagttcatcaagatt

SEQ ID NO: 108 - DNA, 47 bp, Homo Sapiens
  allele 24: 99-12901-316 : polymorphic base A or G
tttttgaattaaatattgtatccrgtaaagtaatgtgtcttcaaagg

SEQ ID NO: 109 - DNA, 47 bp, Homo Sapiens
  allele 24: 99-12903-381 : polymorphic base C or T
gcgtttttgagacagcccaggtgyagtgagcagtccatatccatgga

SEQ ID NO: 110 - DNA, 47 bp, Homo Sapiens
  allele 24: 99-12907-295 : polymorphic base A or G
gctatatggcattatatctccacrgggcagacctgatgtacaagatg

SEQ ID NO: 111 - DNA, 47 bp, Homo Sapiens
  allele 24: 99-12908-369 : polymorphic base G or C
atacaatcacgtatactctaactsacttatagcaagtgtattttagg

SEQ ID NO: 112 - DNA, 47 bp, Homo Sapiens
  allele 24: 99-12913-197 : polymorphic base C or T
gccacaggtcacactgtgtctcayggcttctcacttccgtagagaaa

SEQ ID NO: 113 - DNA, 47 bp, Homo Sapiens
  allele 24: 99-12914-227 : polymorphic base G or T
ggtagatggagaccaccctcacgktcccttccagctatagaaacagt

SEQ ID NO: 114 - DNA, 47 bp, Homo Sapiens
  allele 24: 99-12924-273 : polymorphic base G or C
acatggtggaaaattaagccccasaggtaactacctacctgaacggc

SEQ ID NO: 115 - DNA, 47 bp, Homo Sapiens
  allele 24: 99-12925-487 : polymorphic base C or T
taattgtcaagtagattctactgyatccagtgtctggcacaaaaccc

SEQ ID NO: 116 - DNA, 47 bp, Homo Sapiens
  allele 24: 99-12926-332 : polymorphic base C or T
tcccttaattccctattcttctgycacacactccaggagtgctcctt

SEQ ID NO: 117 - DNA, 47 bp, Homo Sapiens
  allele 24: 99-12931-173 : polymorphic base A or G
ataatggaaaccctgacaggcaargttgtaattacggttgtgccata

SEQ ID NO: 118 - DNA, 47 bp, Homo Sapiens
  allele 24: 99-12948-61 : polymorphic base A or T
ctgactcctcccacagaagtctcwccttttcatatgaataatggcca

SEQ ID NO: 119 - DNA, 47 bp, Homo Sapiens
  allele 24: 99-12952-199 : polymorphic base G or C
ctcgaaggtcacctgcaaaactcsctgtagagacccctaaggctctg

SEQ ID NO: 120 - DNA, 47 bp, Homo Sapiens
  allele 24: 99-12956-43 : polymorphic base C or T
aagctgtaggaggtgcagcatcaycaaggagcaatgccctggatgcc

SEQ ID NO: 121 - DNA, 47 bp, Homo Sapiens
  allele 24: 99-12957-448 : polymorphic base C or T
ccccatcaccagcaagagtctccyaggagcaggctgggagccagcag

SEQ ID NO: 122 - DNA, 47 bp, Homo Sapiens
  allele 24: 99-12961-318 : polymorphic base A or G
agcgtataatgccttctcagtgcrtgttgggtgtatgaatgaataag

SEQ ID NO: 123 - DNA, 47 bp, Homo Sapiens
  allele 24: 99-12962-181 : polymorphic base A or G
aggccttctgtgagtgcagcagcratcaataaagaagcagcccagag

SEQ ID NO: 124 - DNA, 47 bp, Homo Sapiens
  allele 24: 99-12963-255 : polymorphic base C or T
ggtcagcagggataaggcagttgygtatgggagagcatgcgaggagg

SEQ ID NO: 125 - DNA, 47 bp, Homo Sapiens
  allele 24: 99-12964-230 : polymorphic base C or T
tcttccgcttgaaaggcagtgttyggggtcttccaaggcacactgaa

SEQ ID NO: 126 - DNA, 47 bp, Homo Sapiens
  allele 24: 99-13021-124 : polymorphic base C or T
aagtgttcagtagccactagtgaytatcatactggatagtgcagatt

SEQ ID NO: 127 - DNA, 47 bp, Homo Sapiens
  allele 24: 99-13036-313 : polymorphic base A or C
taggttgatcactcagcaagcaamgtccttttacaagaaaaggaaga

SEQ ID NO: 128 - DNA, 47 bp, Homo Sapiens
  allele 24: 99-13045-385 : polymorphic base A or C
ctactgcgtttctcctgctgccamtgaaacattcagcttcttggaag

SEQ ID NO: 129 - DNA, 47 bp, Homo Sapiens
  allele 24: 99-13051-235 : polymorphic base A or G
ccacgagggctgaagaaggggttratggagatggaactgacatactg

SEQ ID NO: 130 - DNA, 47 bp, Homo Sapiens
  allele 24: 99-13061-100 : polymorphic base C or T
agatggagaaaggtcctcatagtytaagcacctagttctacccatac

SEQ ID NO: 131 - DNA, 47 bp, Homo Sapiens
  allele 24: 99-13064-328 : polymorphic base C or T
tggaagaactgaatgtgaatacaytgaagcctcacagaactgaggca

SEQ ID NO: 132 - DNA, 47 bp, Homo Sapiens
  allele 24: 99-13065-311 : polymorphic base C or T
tcccagtaattccatcgaaagtcyctggtctaacactttatggcgag

SEQ ID NO: 133 - DNA, 47 bp, Homo Sapiens
  allele 24: 99-13070-207 : polymorphic base G or T
tgaatcagtaaatgcagagcccakaggtgagaaagcccaaagtgaaa

SEQ ID NO: 134 - DNA, 47 bp, Homo Sapiens
  allele 24: 99-13098-369 : polymorphic base A or G
gtatatcctatttccattttctgraaatagttgcttcctattttttg

SEQ ID NO: 135 - DNA, 47 bp, Homo Sapiens
  allele 24: 99-13106-251 : polymorphic base A or G
ggtactgaaacatttgagatgggraagtcaaaactgtcttgaagtga

SEQ ID NO: 136 - DNA, 47 bp, Homo Sapiens
  allele 24: 99-13115-106 : polymorphic base C or T
ctaggactgcctgaaggttatatygcctgaaattcagaagtttctat

SEQ ID NO: 137 - DNA, 47 bp, Homo Sapiens
  allele 24: 99-13121-198 : polymorphic base A or G
catgagaagggatagcatgtgttrgggattactgtgggagctccttt

SEQ ID NO: 138 - DNA, 47 bp, Homo Sapiens
  allele 24: 99-13130-75 : polymorphic base A or G
cattttataattacattgctacargcactagcaccacacaatttgcc

SEQ ID NO: 139 - DNA, 47 bp, Homo Sapiens
  allele 24: 99-13133-341 : polymorphic base A or G
tcgtctcaaaattacccttccacrcagtgttgggtaaatgaagcgtt

SEQ ID NO: 140 - DNA, 47 bp, Homo Sapiens
  allele 24: 99-13134-79 : polymorphic base A or G
tagggagcgagaaaggtcaaaaartattaacaagcagataattgatg

SEQ ID NO: 141 - DNA, 47 bp, Homo Sapiens
  allele 24: 99-13165-216 : polymorphic base A or G
ttcttgtttattgctgcaaccccrggacctagaacagtacttcatat

SEQ ID NO: 142 - DNA, 47 bp, Homo Sapiens
  allele 24: 99-13178-252 : polymorphic base C or T
tcagacacaaagcaagtgggaaaygggaagccagataatccagtgga

SEQ ID NO: 143 - DNA, 47 bp, Homo Sapiens
  allele 24: 99-13192-272 : polymorphic base A or G
ttgctgggaatttctgtgtacacrtgctcatttatctttttatttat

SEQ ID NO: 144 - DNA, 47 bp, Homo Sapiens
  allele 24: 99-13193-453 : polymorphic base C or T
aagctgcttacataaaattatttygaatatctgcatagatttcttcc

SEQ ID NO: 145 - DNA, 47 bp, Homo Sapiens
  allele 24: 99-13201-154 : polymorphic base C or T
tgaatgaacagtaatttcaatctygggctcattaatcattctacata

SEQ ID NO: 146 - DNA, 47 bp, Homo Sapiens
  allele 24: 99-13203-79 : polymorphic base A or G
tggagccaccctcagaacacgacrtgcagtgcttgtagttgaccagc

SEQ ID NO: 147 - DNA, 47 bp, Homo Sapiens
  allele 24: 99-13215-109 : polymorphic base C or T
tatgttaagccctatagttcctaytctagggtcttacacttagcaag

SEQ ID NO: 148 - DNA, 47 bp, Homo Sapiens
  allele 24: 99-13218-103 : polymorphic base G or C
ggagcaagcaatctactagttctscaccacgttttcagtgctggtgg

SEQ ID NO: 149 - DNA, 47 bp, Homo Sapiens
  allele 24: 99-13219-378 : polymorphic base A or G
ctatggtagggtaacggagaattrtaggtccctattattacagatgc

SEQ ID NO: 150 - DNA, 47 bp, Homo Sapiens
  allele 24: 99-13222-274 : polymorphic base C or T
tcctgaccttaacaatccataggytccccactaggcaggctaactcc

SEQ ID NO: 151 - DNA, 47 bp, Homo Sapiens
  allele 24: 99-13224-351 : polymorphic base C or T
gagtcaagccttctaacaccttgyccaatattccgtttgcaccaata

SEQ ID NO: 152 - DNA, 47 bp, Homo Sapiens
  allele 24: 99-13227-270 : polymorphic base A or C
aataaaatactgtatttaaacagmtgtcagcccttcaaagggtgttt

SEQ ID NO: 153 - DNA, 47 bp, Homo Sapiens
  allele 24: 99-13229-192 : polymorphic base G or T
gacaggaggcaataggcttaagckgcagtatgagggatttagataag

SEQ ID NO: 154 - DNA, 47 bp, Homo Sapiens
  allele 24: 99-13232-494 : polymorphic base G or C
acagaaagtccttgaaacaggcasaacatcttacatgcctgacctta

SEQ ID NO: 155 - DNA, 47 bp, Homo Sapiens
  allele 24: 99-13237-44 : polymorphic base G or T
gtgaacatttttatagtggaactkataccttgtgccatcattatctg

SEQ ID NO: 156 - DNA, 47 bp, Homo Sapiens
  allele 24: 99-13238-276 : polymorphic base A or G
taggtgtagaatatgctgtctccrcaaatagtagaggcctaccaggt

SEQ ID NO: 157 - DNA, 47 bp, Homo Sapiens
  allele 24: 99-13241-49 : polymorphic base C or T
ttcatgtggaacatattgaaataytatttaggcattgtaaatatcgt

SEQ ID NO: 158 - DNA, 47 bp, Homo Sapiens
  allele 24: 99-13246-251 : polymorphic base A or G
cacagcaaagccatcagaaatcartaatcacacagaatagtagtctg

SEQ ID NO: 159 - DNA, 47 bp, Homo Sapiens
  allele 24: 99-13250-439 : polymorphic base C or T
aatgtgctagtcccgtgcaccgayagcatgctccttgagaagaggcg

SEQ ID NO: 160 - DNA, 47 bp, Homo Sapiens
  allele 24: 99-13251-118 : polymorphic base G or T
tgctgctagccgttgggttttccktagtgctgcgaccaagactgtta

SEQ ID NO: 161 - DNA, 47 bp, Homo Sapiens
  allele 24: 99-13258-232 : polymorphic base G or T
aaccctccaaatttctggggaatktgttacccagcaatggataatga

SEQ ID NO: 162 - DNA, 47 bp, Homo Sapiens
  allele 24: 99-13260-358 : polymorphic base G or C
tctctcccagagcatttcctaaasggttgataggacaatagcatgta

SEQ ID NO: 163 - DNA, 47 bp, Homo Sapiens
  allele 24: 99-13262-376 : polymorphic base G or C
cagacagaagttagagaagaccasgctgaattgaaagagttaaactt

SEQ ID NO: 164 - DNA, 47 bp, Homo Sapiens
  allele 24: 99-13269-144 : polymorphic base A or G
tctgacgggtgggagaaagctccrtggggttcagggttgagtcttct

SEQ ID NO: 165 - DNA, 47 bp, Homo Sapiens
  allele 24: 99-13270-309 : polymorphic base G or T
tacattatggtggcagtaacagakgtttatttttcattcactctacg

SEQ ID NO: 166 - DNA, 47 bp, Homo Sapiens
  allele 24: 99-13271-163 : polymorphic base A or G
tttttactttaacacatttttaarttaaaggtagagctcaaaactgt

SEQ ID NO: 167 - DNA, 47 bp, Homo Sapiens
  allele 24: 99-13272-151 : polymorphic base A or G
cattttgggtttggccctcatagrgaaaagaaagatcttgctgtctc

SEQ ID NO: 168 - DNA, 47 bp, Homo Sapiens
  allele 24: 99-13273-144 : polymorphic base A or C
ccaaatacatcacattctgaggtmctgggggtgggagcttcaccata

SEQ ID NO: 169 - DNA, 47 bp, Homo Sapiens
  allele 24: 99-13276-168 : polymorphic base C or T
tttaacagctgcctttgcagtgtytgagaagatgaaaacataatgaa

SEQ ID NO: 170 - DNA, 47 bp, Homo Sapiens
  allele 24: 99-13279-301 : polymorphic base A or G
aaactcagccaatgcaaagctatrcaacaaaccctttgacagccttc

SEQ ID NO: 171 - DNA, 47 bp, Homo Sapiens
  allele 24: 99-13286-58 : polymorphic base A or G
tttgttttgttatcctgcatcttratttatacatcaggcactgtgtt

SEQ ID NO: 172 - DNA, 47 bp, Homo Sapiens
  allele 24: 99-13287-298 : polymorphic base C or T
cttgtctggggaaccagcatgacygggatgcaaggatgccattcctg

SEQ ID NO: 173 - DNA, 47 bp, Homo Sapiens
  allele 24: 99-13294-281 : polymorphic base A or G
ggaacctcatattcgataggcacrgctgtaagattgaggaagatcac

SEQ ID NO: 174 - DNA, 47 bp, Homo Sapiens
  allele 24: 99-13296-330 : polymorphic base C or T
agaaggctttctttttccagttcygtggaatccagtttcctagattg

SEQ ID NO: 175 - DNA, 47 bp, Homo Sapiens
  allele 24: 99-13320-352 : polymorphic base A or G
aggcaagccctgtaccctcgggargccggctgtgtgctctgctgttg

SEQ ID NO: 176 - DNA, 47 bp, Homo Sapiens
  allele 24: 99-13332-259 : polymorphic base C or T
cttcatctatcacggggcgcccgygacgtggggctgctgctctggga

SEQ ID NO: 177 - DNA, 47 bp, Homo Sapiens
  allele 24: 99-13334-136 : polymorphic base A or C
cctttgaccccggacttaagcaamaagcgtggtcttgggcgtagtac

SEQ ID NO: 178 - DNA, 47 bp, Homo Sapiens
  allele 24: 99-13336-364 : polymorphic base A or G
tgagattcaggtctctgagaagarggcacggttaccaaaggaatatg

SEQ ID NO: 179 - DNA, 47 bp, Homo Sapiens
  allele 24: 99-13339-335 : polymorphic base G or C
ttcatgcttagagatatgttaaastgtgtacggctgtttgacggctc

SEQ ID NO: 180 - DNA, 47 bp, Homo Sapiens
  allele 24: 99-13354-225 : polymorphic base A or G
aaagatgaggctagacaatccaarcatgaaaagacctgcataccatg

SEQ ID NO: 181 - DNA, 47 bp, Homo Sapiens
  allele 24: 99-13368-221 : polymorphic base C or T
cacacacaatcgtttttgtatttyatccatctatttttcagcttcga

SEQ ID NO: 182 - DNA, 47 bp, Homo Sapiens
  allele 24: 99-13394-42 : polymorphic base A or G
ggcttgtgagaccatcctgtctgrattaaacttctggtcctcaaaat

SEQ ID NO: 183 - DNA, 47 bp, Homo Sapiens
  allele 24: 99-13395-110 : polymorphic base C or T
ctaagaaagcttaacattgttctytctttaaggaagaaatacttaaa

SEQ ID NO: 184 - DNA, 47 bp, Homo Sapiens
  allele 24: 99-13396-258 : polymorphic base G or C
tttcagcaaaggcctgcagaagtsaggaactgagcctgtgggtatca

SEQ ID NO: 185 - DNA, 47 bp, Homo Sapiens
  allele 24: 99-134-362 : polymorphic base G or T
caaaacactcatgttagttagatkattattcctattacaaagataag

SEQ ID NO: 186 - DNA, 47 bp, Homo Sapiens
  allele 24: 99-13401-106 : polymorphic base A or C
ctcacccagtgacgaccacgacamtgttgatgatcataagcagtgct

SEQ ID NO: 187 - DNA, 47 bp, Homo Sapiens
  allele 24: 99-13404-373 : polymorphic base A or G
ctcatgtcccccgaaatcaccttrtgtttttgtatctttgaatttat

SEQ ID NO: 188 - DNA, 47 bp, Homo Sapiens
  allele 24: 99-13406-279 : polymorphic base G or T
aatgtgcattgtagaatcaatgakatggtgcgacaagagcccccagt

SEQ ID NO: 189 - DNA, 47 bp, Homo Sapiens
  allele 24: 99-1342-51 : polymorphic base C or T
cttaggaattcccggctttagaayttttctgaaacaaaaagcttatt

SEQ ID NO: 190 - DNA, 47 bp, Homo Sapiens
  allele 24: 99-13429-188 : polymorphic base A or C
aaatgcctattatttcttggtggmctgcaaagatttctgttttatat

SEQ ID NO: 191 - DNA, 47 bp, Homo Sapiens
  allele 24: 99-13439-327 : polymorphic base A or G
tcacaaacccgtgaataccaatgraactacagtattgctaataacca

SEQ ID NO: 192 - DNA, 47 bp, Homo Sapiens
  allele 24: 99-13443-275 : polymorphic base C or T
acgcccttcgccgcccagcgagtygtggagccgcagctccgagtgtg

SEQ ID NO: 193 - DNA, 47 bp, Homo Sapiens
  allele 24: 99-13450-276 : polymorphic base A or G
ccatttaatattttcagactgcarttgactgtgggtaactgaaacct

SEQ ID NO: 194 - DNA, 47 bp, Homo Sapiens
  allele 24: 99-13457-138 : polymorphic base G or C
atacggaaaatctctgtaccctcsttttaattttgctgtgaacctaa

SEQ ID NO: 195 - DNA, 47 bp, Homo Sapiens
  allele 24: 99-1346-503 : polymorphic base C or T
cgtgttacccttcaacacccacaygtccacgtgggccctggggtctc

SEQ ID NO: 196 - DNA, 47 bp, Homo Sapiens
  allele 24: 99-13462-263 : polymorphic base A or G
caatcttttcaacatcaggaagtratatctccagggaaatgtgagct

SEQ ID NO: 197 - DNA, 47 bp, Homo Sapiens
  allele 24: 99-13486-358 : polymorphic base A or G
ttctagtccccaaaagccctcccrggtcttcccctctctgagtcccc

SEQ ID NO: 198 - DNA, 47 bp, Homo Sapiens
  allele 24: 99-13489-396 : polymorphic base C or T
gttttacacagccagggcactcayaacctagtattggaggcgtttta

SEQ ID NO: 199 - DNA, 47 bp, Homo Sapiens
  allele 24: 99-13499-445 : polymorphic base A or G
ttagaagtggagatggcgttttcrttacccagacgggtgttataatt

SEQ ID NO: 200 - DNA, 47 bp, Homo Sapiens
  allele 24: 99-13502-118 : polymorphic base C or T
ctattctattctcaagtagccatytccttaccttacccataggcaaa

SEQ ID NO: 201 - DNA, 47 bp, Homo Sapiens
  allele 24: 99-13509-388 : polymorphic base A or G
atctccccgtgttcaatctttcarctacaattttgccttttgtcagt

SEQ ID NO: 202 - DNA, 47 bp, Homo Sapiens
  allele 24: 99-1351-264 : polymorphic base A or T
gttttgactcctaatatgatatgwgttttccatgtattaaaggggat

SEQ ID NO: 203 - DNA, 47 bp, Homo Sapiens
  allele 24: 99-13515-428 : polymorphic base C or T
agtaaacatgcaacagatctacaygaaagaaaatctgaaagacatcc

SEQ ID NO: 204 - DNA, 47 bp, Homo Sapiens
  allele 24: 99-13525-395 : polymorphic base C or T
tattatatgattttagaaagaaayatcattctgcttttctgcctctt

SEQ ID NO: 205 - DNA, 47 bp, Homo Sapiens
  allele 24: 99-13526-368 : polymorphic base C or T
taaatacaaaacaaatcatggagytctttaaatacctcatgattgga

SEQ ID NO: 206 - DNA, 47 bp, Homo Sapiens
  allele 24: 99-13531-449 : polymorphic base A or T
gatttattattatattctggttawgagttagttgtcaattatacatg

SEQ ID NO: 207 - DNA, 47 bp, Homo Sapiens
  allele 24: 99-13536-134 : polymorphic base C or T
aattactgctaataaattttccayttctgaagcatgatattcacccc

SEQ ID NO: 208 - DNA, 47 bp, Homo Sapiens
  allele 24: 99-13540-338 : polymorphic base G or C
ttagacagcttctgtacataggasaaatgcttaattagtgtgtcatt

SEQ ID NO: 209 - DNA, 47 bp, Homo Sapiens
  allele 24: 99-13541-85 : polymorphic base A or G
aggcacctcttctgcttgcatgcrggctgttaccaggggagacattt

SEQ ID NO: 210 - DNA, 47 bp, Homo Sapiens
  allele 24: 99-13545-215 : polymorphic base C or T
catacagcatcctggtggaacaaygacctgtgcgcttctgagaacag

SEQ ID NO: 211 - DNA, 47 bp, Homo Sapiens
  allele 24: 99-13552-172 : polymorphic base A or C
taaatagtaatgagctcattttcmtagaatggaacttataattccag

SEQ ID NO: 212 - DNA, 47 bp, Homo Sapiens
  allele 24: 99-13553-390 : polymorphic base A or C
aaatagtttagaagttgaatttcmcagccattattgttttaattatg

SEQ ID NO: 213 - DNA, 47 bp, Homo Sapiens
  allele 24: 99-13555-402 : polymorphic base A or G
tctgagtggtacaaaaaataacartatgttttaattatatgatgtct

SEQ ID NO: 214 - DNA, 47 bp, Homo Sapiens
  allele 24: 99-1356-500 : polymorphic base A or T
ttcatgtgatgctgagccttccgwagattttcagctctagtgtgatt

SEQ ID NO: 215 - DNA, 47 bp, Homo Sapiens
  allele 24: 99-13567-258 : polymorphic base C or T
tgagagtcatataatttaatcatyacttaccaggaagttgccttcaa

SEQ ID NO: 216 - DNA, 47 bp, Homo Sapiens
  allele 24: 99-13586-230 : polymorphic base G or T
tttgagaaggacactggacttttktcacacagggcaaggatggggaa

SEQ ID NO: 217 - DNA, 47 bp, Homo Sapiens
  allele 24: 99-13588-238 : polymorphic base A or C
tcaaaagaatgctacaaagttctmtttgagatctgaaaataacttag

SEQ ID NO: 218 - DNA, 47 bp, Homo Sapiens
  allele 24: 99-13589-362 : polymorphic base A or G
atacgaaatgaggatgtggtggcrtggggtggtccctgccactttgt

SEQ ID NO: 219 - DNA, 47 bp, Homo Sapiens
  allele 24: 99-1359-355 : polymorphic base C or T
gtcctgggaggctaactccttctygggcctctcttccccccagcgcg

SEQ ID NO: 220 - DNA, 47 bp, Homo Sapiens
  allele 24: 99-13591-360 : polymorphic base G or C
gccacaaacagatcaggttggtgscatctccatgggcattatttgct

SEQ ID NO: 221 - DNA, 47 bp, Homo Sapiens
  allele 24: 99-13592-304 : polymorphic base A or C
gtatcctcatgtggaatgggaagmttcccttccaggataatcttgct

SEQ ID NO: 222 - DNA, 47 bp, Homo Sapiens
  allele 24: 99-13596-69 : polymorphic base A or C
cagtgacaaaggacgagtggctgmctcagttttaatcatctgccaca

SEQ ID NO: 223 - DNA, 47 bp, Homo Sapiens
  allele 24: 99-13598-260 : polymorphic base G or C
ataaccagctgggattcaagaaasacttattagggaaagaatgaggg

SEQ ID NO: 224 - DNA, 47 bp, Homo Sapiens
  allele 24: 99-13600-305 : polymorphic base A or G
ctcctccatgctttcctgctttgrgtcctccaggtctcttttttact

SEQ ID NO: 225 - DNA, 47 bp, Homo Sapiens
  allele 24: 99-13601-360 : polymorphic base A or G
aaattagcaaagggacagtctcaratgtttgctgtataaagtgtatt

SEQ ID NO: 226 - DNA, 47 bp, Homo Sapiens
  allele 24: 99-13605-208 : polymorphic base C or T
atttttgctgactttttaggtgtytgaaacatttaaaagggtctgac

SEQ ID NO: 227 - DNA, 47 bp, Homo Sapiens
  allele 24: 99-13606-83 : polymorphic base G or C
ttaaaaaataatgcaaacaaaaastaaatatataagaatgtatgtta

SEQ ID NO: 228 - DNA, 47 bp, Homo Sapiens
  allele 24: 99-1362-126 : polymorphic base A or G
gtcacatggtgagcaagcaggtgragctggaactctggacccacggt

SEQ ID NO: 229 - DNA, 47 bp, Homo Sapiens
  allele 24: 99-13624-415 : polymorphic base C or T
acacagaagagttccaaacacttyaaaagtgctgtacagatctctag

SEQ ID NO: 230 - DNA, 47 bp, Homo Sapiens
  allele 24: 99-13638-354 : polymorphic base A or G
gatttaagagctctatctgttacrggagctaatgcttacctttatga

SEQ ID NO: 231 - DNA, 47 bp, Homo Sapiens
  allele 24: 99-13644-439 : polymorphic base G or C
tacattttctcctctcgataaacstcagaatggtatccatcatacct

SEQ ID NO: 232 - DNA, 47 bp, Homo Sapiens
  allele 24: 99-13647-278 : polymorphic base C or T
aacatgtaggatgtgagaatgatyagaagagactggacgttgctgta

SEQ ID NO: 233 - DNA, 47 bp, Homo Sapiens
  allele 24: 99-13652-407 : polymorphic base G or C
taacattatttgtcatttagtagsctgtttgaatatattgttgaaca

SEQ ID NO: 234 - DNA, 47 bp, Homo Sapiens
  allele 24: 99-13663-218 : polymorphic base C or T
ctcattcccttcctgcttcattayaagtgtgctaaattggctgcatc

SEQ ID NO: 235 - DNA, 47 bp, Homo Sapiens
  allele 24: 99-13666-275 : polymorphic base A or T
ccatagagaggaaaatagttttcwttgtttttcaaataatttacagt

SEQ ID NO: 236 - DNA, 47 bp, Homo Sapiens
  allele 24: 99-1367-287 : polymorphic base A or G
aaggaaagcacaaagaaagagaartgaggaggaggagagaatccaga

SEQ ID NO: 237 - DNA, 47 bp, Homo Sapiens
  allele 24: 99-13671-396 : polymorphic base C or T
aacaacagatccactcaaaaatgytctaacaatcaattaagtattca

SEQ ID NO: 238 - DNA, 47 bp, Homo Sapiens
  allele 24: 99-13678-251 : polymorphic base C or T
ccaaggaagtcctttgcaaagtayaggggagcgaggaatggagacac

SEQ ID NO: 239 - DNA, 47 bp, Homo Sapiens
  allele 24: 99-13679-285 : polymorphic base C or T
acctcagtcacactggcctctgtygtttctcagatatgtgaagcaca

SEQ ID NO: 240 - DNA, 47 bp, Homo Sapiens
  allele 24: 99-1368-299 : polymorphic base C or T
tactgattgatttttcaaaacagygagcatgtattaaaattaaatgc

SEQ ID NO: 241 - DNA, 47 bp, Homo Sapiens
  allele 24: 99-13684-488 : polymorphic base A or C
ctccttcttccctccatggtgggmggaggtcaggaagagggaagaca

SEQ ID NO: 242 - DNA, 47 bp, Homo Sapiens
  allele 24: 99-13687-316 : polymorphic base A or G
gatcccaccctcctgtgtctcctrgtcacttctcccttcctgttttt

SEQ ID NO: 243 - DNA, 47 bp, Homo Sapiens; identical to SEQ ID NO: 202
  allele 24: 99-1373-358 : polymorphic base A or T

SEQ ID NO: 244 - DNA, 47 bp, Homo Sapiens
  allele 24: 99-1376-196 : polymorphic base A or T
cagtgttcaatgaatagtagtttwtattaatattaatattgttataa

SEQ ID NO: 245 - DNA, 47 bp, Homo Sapiens
  allele 24: 99-13790-129 : polymorphic base C or T
aagttcaggttgccagtgaaaagyaaaggaacttgaaattcatgtta

SEQ ID NO: 246 - DNA, 47 bp, Homo Sapiens
  allele 24: 99-13798-284 : polymorphic base A or G
agattaacggcatgagctttagcrgcagctaaccccgtgcagatgtg

SEQ ID NO: 247 - DNA, 47 bp, Homo Sapiens
  allele 24: 99-13831-102 : polymorphic base A or G
ggggacataatggatgagaaagtrgaggggaagaactatgaatacta

SEQ ID NO: 248 - DNA, 47 bp, Homo Sapiens
  allele 24: 99-13832-226 : polymorphic base C or T
tctggatctgtaggccaggactgyatggctacctagactgtagttgt

SEQ ID NO: 249 - DNA, 47 bp, Homo Sapiens
  allele 24: 99-13835-39 : polymorphic base G or C
tacatgattctgtcttatatctasatgtacaaaagttctaactggat

SEQ ID NO: 250 - DNA, 47 bp, Homo Sapiens
  allele 24: 99-1385-91 : polymorphic base G or C
tctccctgaactctctatcttctsaaccaagcaaacgtactaaaccc

SEQ ID NO: 251 - DNA, 47 bp, Homo Sapiens
  allele 24: 99-13853-256 : polymorphic base C or T
taatattacggacataacattaayattgttttagcctcctggaggtg

SEQ ID NO: 252 - DNA, 47 bp, Homo Sapiens
  allele 24: 99-13854-363 : polymorphic base C or T
ggaggaccagcctaatgccagtgycccccactgcttacaggctgggg

SEQ ID NO: 253 - DNA, 47 bp, Homo Sapiens
  allele 24: 99-13860-368 : polymorphic base C or T
aaaaagggaatggaactagctatyacagtatgttaggaaatgactgg

SEQ ID NO: 254 - DNA, 47 bp, Homo Sapiens
  allele 24: 99-13861-227 : polymorphic base A or G
tccaggagatacctcagaatatcrtgcagataccctctaggtgagct

SEQ ID NO: 255 - DNA, 47 bp, Homo Sapiens
  allele 24: 99-13866-198 : polymorphic base C or T
ccacccaggttggagcccctcacygaggcctgatgcccaggcgaatt

SEQ ID NO: 256 - DNA, 47 bp, Homo Sapiens
  allele 24: 99-13868-240 : polymorphic base C or T
aaggagtctccaaataattttaaycaggaaagtgtcatgtctaggtc

SEQ ID NO: 257 - DNA, 47 bp, Homo Sapiens
  allele 24: 99-1387-462 : polymorphic base C or T
acaaggaggtgaatgaggaggaayccgccgcgctaatctaggcatgg

SEQ ID NO: 258 - DNA, 47 bp, Homo Sapiens
  allele 24: 99-13876-55 : polymorphic base A or G
tttttaataatattttatatggtrttctgccctcataaaaactgaat

SEQ ID NO: 259 - DNA, 47 bp, Homo Sapiens
  allele 24: 99-13878-385 : polymorphic base A or C
ggcttaggtttacagttctcggcmtgtatgacatacagcgtggtgga

SEQ ID NO: 260 - DNA, 47 bp, Homo Sapiens
  allele 24: 99-1388-242 : polymorphic base A or G
cttttactgaatatcacgattgcrgttcagaataaaaatggcctggg

SEQ ID NO: 261 - DNA, 47 bp, Homo Sapiens
  allele 24: 99-13880-185 : polymorphic base A or G
aagcccactggagtttttgctaarcatcttatcctctgagaccctat

SEQ ID NO: 262 - DNA, 47 bp, Homo Sapiens
  allele 24: 99-13883-103 : polymorphic base A or G
gtactcatttataaaatatatctrtgtacagatacaaatacgtatga

SEQ ID NO: 263 - DNA, 47 bp, Homo Sapiens
  allele 24: 99-13887-190 : polymorphic base C or T
aaatgaatgaatgaattctgaagygaaaacataacattcttaaattt

SEQ ID NO: 264 - DNA, 47 bp, Homo Sapiens
  allele 24: 99-13888-332 : polymorphic base C or T
gagagattcttggattcttgtttygtgacttctgatccagggctttg

SEQ ID NO: 265 - DNA, 47 bp, Homo Sapiens
  allele 24: 99-13892-338 : polymorphic base A or G
tttttttttgtaataatattactrtttttctgttatcaaagtaaata

SEQ ID NO: 266 - DNA, 47 bp, Homo Sapiens
  allele 24: 99-13897-431 : polymorphic base G or T
ggtgtggactctatttctagctgkttttttttctatgggtgttcctt

SEQ ID NO: 267 - DNA, 47 bp, Homo Sapiens
  allele 24: 99-1391-204 : polymorphic base C or T
cctcttaagaccatagaaaaactyaattggatcagaaaccccccatg

SEQ ID NO: 268 - DNA, 47 bp, Homo Sapiens
  allele 24: 99-13912-89 : polymorphic base C or T
tttgacctgaaatattaacattayttaccatagaatgacttgtacct

SEQ ID NO: 269 - DNA, 47 bp, Homo Sapiens
  allele 24: 99-13913-278 : polymorphic base A or G
actctcttctgcccacccctctcrtccaactggcccaaggaggaccc

SEQ ID NO: 270 - DNA, 47 bp, Homo Sapiens
  allele 24: 99-13914-169 : polymorphic base A or G
tctaggtgacggagaccagaaaargggtttggggggctggggtgcca

SEQ ID NO: 271 - DNA, 47 bp, Homo Sapiens
  allele 24: 99-1392-200 : polymorphic base C or T
ttctcatttgtaatatattagacyccaaggctgtccagaggcatcct

SEQ ID NO: 272 - DNA, 47 bp, Homo Sapiens
  allele 24: 99-13920-172 : polymorphic base A or G
caaaggcctgggggacagcaggcrtgtgcccccgcatgagtgactga

SEQ ID NO: 273 - DNA, 47 bp, Homo Sapiens
  allele 24: 99-13925-97 : polymorphic base A or G
acctggaaacaactctaatgcccrtcaacagaggaatggatggataa

SEQ ID NO: 274 - DNA, 47 bp, Homo Sapiens
  allele 24: 99-13929-201 : polymorphic base A or C
aaagaacccataagtttattttamaatacctactcagaagcaaaact

SEQ ID NO: 275 - DNA, 47 bp, Homo Sapiens
  allele 24: 99-13932-229 : polymorphic base C or T
gagggaaaggcattccagataaayggaagcgtggctgcaaaagagag

SEQ ID NO: 276 - DNA, 47 bp, Homo Sapiens
  allele 24: 99-1394-271 : polymorphic base A or G
  misc_feature 18: n=a, g, c or t
catgcttgtaatcccaanactttrgggggctgaggaaagaggcttgc

SEQ ID NO: 277 - DNA, 47 bp, Homo Sapiens
  allele 24: 99-13956-119 : polymorphic base G or C
ggaagaacaggtgcagaagccctsggggagcaaatgatgggttgaat

SEQ ID NO: 278 - DNA, 47 bp, Homo Sapiens
  allele 24: 99-13960-142 : polymorphic base C or T
tcctcattttcctctatggctacyagtcaatttctgaggtttgactg

SEQ ID NO: 279 - DNA, 47 bp, Homo Sapiens
  allele 24: 99-13962-339 : polymorphic base A or G
tgcttctagattacttactactaraaagtttcatagaaaaaaatagc

SEQ ID NO: 280 - DNA, 47 bp, Homo Sapiens
  allele 24: 99-13980-150 : polymorphic base C or T
ctgtggttctcccatacaactgaygtgtttttcacctcaagaaacct

SEQ ID NO: 281 - DNA, 47 bp, Homo Sapiens
  allele 24: 99-13996-123 : polymorphic base A or G
gagacacatgggagcttagaccargtagtaatggttgagagggtcta

SEQ ID NO: 282 - DNA, 47 bp, Homo Sapiens
  allele 24: 99-13997-181 : polymorphic base C or T
gaaaaataataaaaagattaccaycaccataaaaaaggagaccatcc

SEQ ID NO: 283 - DNA, 47 bp, Homo Sapiens
  allele 24: 99-13998-421 : polymorphic base C or T
ataaataaaatgaagaaactagtyagcatggttttatgttttgcttt

SEQ ID NO: 284 - DNA, 47 bp, Homo Sapiens
  allele 24: 99-140-130 : polymorphic base C or T
tgttcaaaagcagctacagaccayatgtaaacaattgagcatggctg

SEQ ID NO: 285 - DNA, 47 bp, Homo Sapiens
  allele 24: 99-14004-328 : polymorphic base G or C
ggttggggcctggttagagatggsgaggggggaagaggggctatccg

SEQ ID NO: 286 - DNA, 47 bp, Homo Sapiens
  allele 24: 99-14005-344 : polymorphic base C or T
atgaaaagctctcaacaactgaaygactaaagaaagggagggactgc

SEQ ID NO: 287 - DNA, 47 bp, Homo Sapiens
  allele 24: 99-14009-133 : polymorphic base C or T
gtcatgatgtctttacaactcctyagaggtcctccgcatgcaattcc

SEQ ID NO: 288 - DNA, 47 bp, Homo Sapiens
  allele 24: 99-14010-165 : polymorphic base C or T
ctatttgaatggagaagctgctcyggttgtggttggttcatgggctt

SEQ ID NO: 289 - DNA, 47 bp, Homo Sapiens
  allele 24: 99-14013-125 : polymorphic base C or T
ctaatagcacttggggatatttayaggtccttgtaaataccacaatg

SEQ ID NO: 290 - DNA, 47 bp, Homo Sapiens
  allele 24: 99-14025-459 : polymorphic base A or G
aaatagattctcattttggggggrtgtggcagaaagcatggcagcta

SEQ ID NO: 291 - DNA, 47 bp, Homo Sapiens
  allele 24: 99-1404-135 : polymorphic base A or G
ttattttttaaaccactggtgatrtaaacaagcaagcaaattatatg

SEQ ID NO: 292 - DNA, 47 bp, Homo Sapiens
  allele 24: 99-14046-270 : polymorphic base A or G
ggaaatatgatggtacctaccgtrtagcctcgtactgaatattaaat

SEQ ID NO: 293 - DNA, 47 bp, Homo Sapiens
  allele 24: 99-14050-295 : polymorphic base G or T
cttcctacctccagaggtaaccaktatctgaatgtaatatttatcag

SEQ ID NO: 294 - DNA, 47 bp, Homo Sapiens
  allele 24: 99-14068-214 : polymorphic base C or T
ctgaagttttgtgcctgttccctygggtgatattctaagtaatacct

SEQ ID NO: 295 - DNA, 47 bp, Homo Sapiens
  allele 24: 99-14072-363 : polymorphic base C or T
tatcccaaatgatggggctatcaytagattaactagttgggtagatg

SEQ ID NO: 296 - DNA, 47 bp, Homo Sapiens
  allele 24: 99-14080-436 : polymorphic base G or T
tcaggcttttggctaagatcaagkgtgaaataccatattcatcatat

SEQ ID NO: 297 - DNA, 47 bp, Homo Sapiens
  allele 24: 99-14083-346 : polymorphic base A or G
ttatatacttagttattaattcartatttagatattcaataattatt

SEQ ID NO: 298 - DNA, 47 bp, Homo Sapiens
  allele 24: 99-14087-429 : polymorphic base G or T
ggacaatttgctcagcctatgtaktctcatgtggaagcaggtcacag

SEQ ID NO: 299 - DNA, 47 bp, Homo Sapiens
  allele 24: 99-14090-398 : polymorphic base A or T
gcaattctgagtccctaattatgwcaaaaccaatgaaggtgactgaa

SEQ ID NO: 300 - DNA, 47 bp, Homo Sapiens
  allele 24: 99-14094-274 : polymorphic base A or T
tggcaaagatacttcttcagaaawcaaatttatggcagaaattaata

SEQ ID NO: 301 - DNA, 47 bp, Homo Sapiens
  allele 24: 99-14119-101 : polymorphic base C or T
ttctactcctcacttattcttaayatcgtcaggctttccatctcatt

SEQ ID NO: 302 - DNA, 47 bp, Homo Sapiens
  allele 24: 99-14120-283 : polymorphic base A or G
ctggattttcaggacccaacaaarcttgtttgaccagtcaggtgaaa

SEQ ID NO: 303 - DNA, 47 bp, Homo Sapiens
  allele 24: 99-14127-127 : polymorphic base A or G
atttgcagggctattcaaagcatrgttcctggaccaacagaatcagc

SEQ ID NO: 304 - DNA, 47 bp, Homo Sapiens
  allele 24: 99-1413-137 : polymorphic base G or C
gggagagtgaaggagaaacttccsggaaatgatcagaactattttaa

SEQ ID NO: 305 - DNA, 47 bp, Homo Sapiens
  allele 24: 99-14135-375 : polymorphic base C or T
taaactttattatcttcattttayaaatgtaaaaacatggggtgaaa

SEQ ID NO: 306 - DNA, 47 bp, Homo Sapiens
  allele 24: 99-14139-321 : polymorphic base A or T
ggaggtgaatattgaatagtctawatcagacattctaattctaatta

SEQ ID NO: 307 - DNA, 47 bp, Homo Sapiens
  allele 24: 99-14140-310 : polymorphic base A or G
taggaaattcagttctgtagcctrtcttctaggtgggtctcccgcca

SEQ ID NO: 308 - DNA, 47 bp, Homo Sapiens
  allele 24: 99-14145-220 : polymorphic base G or C
tccgggcgttgaagggtgagtgtsagtgcggctttatggaggcagct

SEQ ID NO: 309 - DNA, 47 bp, Homo Sapiens
  allele 24: 99-14147-369 : polymorphic base A or G
tttccattagaacttgtgtaagtrgaagattgaatatagatttttaa

SEQ ID NO: 310 - DNA, 47 bp, Homo Sapiens
  allele 24: 99-14149-351 : polymorphic base G or C
gtttttggaataagaataaatgasaattgctaagttctgtttgggag

SEQ ID NO: 311 - DNA, 47 bp, Homo Sapiens
  allele 24: 99-1416-589 : polymorphic base A or G
gttacactcagtgtttcctcccartctcatgattgactatggaaaac

SEQ ID NO: 312 - DNA, 47 bp, Homo Sapiens
  allele 24: 99-14161-267 : polymorphic base A or G
cgtcactcactgttctgggtaaargcagatctagccttcttctgaag

SEQ ID NO: 313 - DNA, 47 bp, Homo Sapiens
  allele 24: 99-14162-180 : polymorphic base C or T
ggaggctcctacagtcagccggaygggatgacccagcccctctttgg

SEQ ID NO: 314 - DNA, 47 bp, Homo Sapiens
  allele 24: 99-14166-217 : polymorphic base G or C
ctgagggaaggagaggtgatggasgtgaggggacatctctgctttcg

SEQ ID NO: 315 - DNA, 47 bp, Homo Sapiens
  allele 24: 99-14175-380 : polymorphic base A or G
tattctttatttttaagctttgcrtcctaagggtgtggtagtgtgtt

SEQ ID NO: 316 - DNA, 47 bp, Homo Sapiens
  allele 24: 99-14179-191 : polymorphic base A or G
caaagcccctaagtttaggtgagrtgaagtagataccctcaaacatg

SEQ ID NO: 317 - DNA, 47 bp, Homo Sapiens
  allele 24: 99-14186-424 : polymorphic base A or G
aataagataaaataaacatgtgarcaatattgtagaaaactattata

SEQ ID NO: 318 - DNA, 47 bp, Homo Sapiens
  allele 24: 99-14197-144 : polymorphic base A or G
tttggagtgattagtgatgtggaraatctttagtttcacctgtgaat

SEQ ID NO: 319 - DNA, 47 bp, Homo Sapiens
  allele 24: 99-14203-268 : polymorphic base A or C
ttctcagtatgctggtggatttcmctgtgggatgaggtagattcaac

SEQ ID NO: 320 - DNA, 47 bp, Homo Sapiens
  allele 24: 99-14204-468 : polymorphic base G or T
tttgtaaaatgataattcttaatkttttaaagatgtagtaagagagg

SEQ ID NO: 321 - DNA, 47 bp, Homo Sapiens
  allele 24: 99-14220-351 : polymorphic base A or G
gaaggaccaggtcaatttatgatrtttggagtggtatccacagaaat

SEQ ID NO: 322 - DNA, 47 bp, Homo Sapiens
  allele 24: 99-1423-361 : polymorphic base A or C
ctcagaattatttgagtggttgtmgaattcctagaaggtaaatgaca

SEQ ID NO: 323 - DNA, 47 bp, Homo Sapiens
  allele 24: 99-14250-381 : polymorphic base A or G
cagagtgtagttaacaggcatgcrtggctgatgtggcagcagttggt

SEQ ID NO: 324 - DNA, 47 bp, Homo Sapiens
  allele 24: 99-14254-305 : polymorphic base G or T
tataataataaagttaaattaagktttcaaattctttcctccataaa

SEQ ID NO: 325 - DNA, 47 bp, Homo Sapiens
  allele 24: 99-14256-133 : polymorphic base C or T
acttgcaatctagtactagttatytccagcttaccattaggttagtt

SEQ ID NO: 326 - DNA, 47 bp, Homo Sapiens
  allele 24: 99-1426-185 : polymorphic base C or T
atgccagtttctttcctcctaggyttttgtggagagactgagaaaat

SEQ ID NO: 327 - DNA, 47 bp, Homo Sapiens
  allele 24: 99-14260-261 : polymorphic base C or T
tttttcagtctaggtggtaagtgycccagatgttcatgctattcctt

SEQ ID NO: 328 - DNA, 47 bp, Homo Sapiens
  allele 24: 99-14277-73 : polymorphic base A or G
catagcatagactccagggccagrctgcctggacttgcccctgtgag

SEQ ID NO: 329 - DNA, 47 bp, Homo Sapiens
  allele 24: 99-14282-334 : polymorphic base A or C
ttaaactggagatgtgaagcaagmctgaggaaataatgaatattagt

SEQ ID NO: 330 - DNA, 47 bp, Homo Sapiens
  allele 24: 99-14285-381 : polymorphic base C or T
acagcagcagactgggttacttcygcaccttattactatccaggagg

SEQ ID NO: 331 - DNA, 47 bp, Homo Sapiens
  allele 24: 99-14286-220 : polymorphic base G or T
ggttctctgtaagttttgaagackcccagaactagagatgaaggtca

SEQ ID NO: 332 - DNA, 47 bp, Homo Sapiens
  allele 24: 99-14309-259 : polymorphic base C or T
tctctacttagacattaaggtaayactatctttaaaawaaaatagtg

SEQ ID NO: 333 - DNA, 47 bp, Homo Sapiens
  allele 24: 99-14315-405 : polymorphic base A or C
ttggttgtgagaacctctttttamaggtaattttagttgtcaaacta

SEQ ID NO: 334 - DNA, 47 bp, Homo Sapiens
  allele 24: 99-14329-205 : polymorphic base G or C
tgagtagtgtatgaagctgcccasttatatgccttggataactgagc

SEQ ID NO: 335 - DNA, 47 bp, Homo Sapiens
  allele 24: 99-14331-64 : polymorphic base A or G
aaaagtggccttgagccagccacrcgctcctatctagtctcagttgg

SEQ ID NO: 336 - DNA, 47 bp, Homo Sapiens
  allele 24: 99-14332-437 : polymorphic base C or T
ccccaaccccctccagcaagtgtycttaaaggaaaagggattttcta

SEQ ID NO: 337 - DNA, 47 bp, Homo Sapiens
  allele 24: 99-14343-408 : polymorphic base A or G
ttattaagtgcttactatgtaccrggcaatattctaagtgcttaagt

SEQ ID NO: 338 - DNA, 47 bp, Homo Sapiens
  allele 24: 99-14345-139 : polymorphic base C or T
aataatgtattttcacaaataagyatatttatttcatctatctcacc

SEQ ID NO: 339 - DNA, 47 bp, Homo Sapiens
  allele 24: 99-14356-141 : polymorphic base A or G
aactagatagtatagtgtgtaggragtacaaagcaggtattcatcag

SEQ ID NO: 340 - DNA, 47 bp, Homo Sapiens
  allele 24: 99-1437-325 : polymorphic base C or T
caagagctgacatttactgcatayttaatttgtgccgaacactgaac

SEQ ID NO: 341 - DNA, 47 bp, Homo Sapiens
  allele 24: 99-14385-117 : polymorphic base A or T
tcagctgttcggcgtctccaaggwtgtgtgggcccctgggatctgat

SEQ ID NO: 342 - DNA, 47 bp, Homo Sapiens
  allele 24: 99-14392-431 : polymorphic base A or C
gtttccttcaccagacttggttamgacttaagtcaaaacattcttct

SEQ ID NO: 343 - DNA, 47 bp, Homo Sapiens
  allele 24: 99-14393-190 : polymorphic base C or T
tataaaaattattgtgtgtgtctycttgtacacctgcgtgagagttt

SEQ ID NO: 344 - DNA, 47 bp, Homo Sapiens
  allele 24: 99-144-392 : polymorphic base C or T
aaaatttaacctctataactgaaytgagccaattcccactacctcat

SEQ ID NO: 345 - DNA, 47 bp, Homo Sapiens
  allele 24: 99-14405-105 : polymorphic base A or G
aaagtatggagcatagagaaaatrtactcaccgtggacctgatgaag

SEQ ID NO: 346 - DNA, 47 bp, Homo Sapiens
  allele 24: 99-1442-224 : polymorphic base G or T
attaatctcagtcatattttgggktttttttcttctcttataattaa

SEQ ID NO: 347 - DNA, 47 bp, Homo Sapiens
  allele 24: 99-14444-193 : polymorphic base G or C
tcttttgtcgaacgattagcagasctaatgagattaacttgaccaat

SEQ ID NO: 348 - DNA, 47 bp, Homo Sapiens
  allele 24: 99-14446-337 : polymorphic base A or G
aacactgtggtgacagttaagtgrcatctgttattcccattttatta

SEQ ID NO: 349 - DNA, 47 bp, Homo Sapiens
  allele 24: 99-14452-263 : polymorphic base C or T
tttctgtttgttaatttattagaytatgaattcatcaggacttctta

SEQ ID NO: 350 - DNA, 47 bp, Homo Sapiens
  allele 24: 99-14459-44 : polymorphic base G or C
attgtttatgattttatagaggasattttcacaagaggaacttttcc

SEQ ID NO: 351 - DNA, 47 bp, Homo Sapiens
  allele 24: 99-14468-247 : polymorphic base C or T
attcctttatgagcttccccctaygtacacacggtggacagttttcc

SEQ ID NO: 352 - DNA, 47 bp, Homo Sapiens
  allele 24: 99-14470-243 : polymorphic base A or G
tgcacttgccgaagtactttcccrtggcgtatcttctttgattgtaa

SEQ ID NO: 353 - DNA, 47 bp, Homo Sapiens
  allele 24: 99-14492-322 : polymorphic base C or T
tcatgttactctgctatgtaatayccattagtgtcttccatttgctt

SEQ ID NO: 354 - DNA, 47 bp, Homo Sapiens
  allele 24: 99-14497-220 : polymorphic base A or G
agtaaatttttataggaaaagaartgtttaaaaatctcttttaaaaa

SEQ ID NO: 355 - DNA, 47 bp, Homo Sapiens
  allele 24: 99-14505-250 : polymorphic base C or T
aaacaatccttctgtaatggcttyggcctcctctggcatgaattgag

SEQ ID NO: 356 - DNA, 47 bp, Homo Sapiens
  allele 24: 99-14518-57 : polymorphic base C or T
ggctgggatgtaggagagccgtcyccagctgcatcctggagctctgg

SEQ ID NO: 357 - DNA, 47 bp, Homo Sapiens
  allele 24: 99-1453-204 : polymorphic base C or T
atcaggccccaaaaggcactgaayraaacagcagtcacatcactccc

SEQ ID NO: 358 - DNA, 47 bp, Homo Sapiens
  allele 24: 99-14553-224 : polymorphic base C or T
tcttttgggggtaattttggagayttgttaaggtctctcacccattc

SEQ ID NO: 359 - DNA, 47 bp, Homo Sapiens
  allele 24: 99-14562-402 : polymorphic base A or G
atcatttatcattttctgacactrtatgatgtagacagtggtataca

SEQ ID NO: 360 - DNA, 47 bp, Homo Sapiens
  allele 24: 99-14566-320 : polymorphic base C or T
tgtaagaaggaaaacatctctgayggaattaaattaaggttgatata

SEQ ID NO: 361 - DNA, 47 bp, Homo Sapiens
  allele 24: 99-14574-310 : polymorphic base G or C
gttcctccaaagcccagttcccasataactgtcattatgttcccttt

SEQ ID NO: 362 - DNA, 47 bp, Homo Sapiens
  allele 24: 99-14581-365 : polymorphic base C or T
gtgtgcacgtgtgtatgtgtgtgygtgtgttattgtgattgtttcat

SEQ ID NO: 363 - DNA, 47 bp, Homo Sapiens
  allele 24: 99-14591-172 : polymorphic base G or C
ctttggatgcagagtgtgaaacasttctcttttctgagctcagttgc

SEQ ID NO: 364 - DNA, 47 bp, Homo Sapiens
  allele 24: 99-14595-210 : polymorphic base C or T
ctatattcaagatattattttgcyatgcttatttgattcaattgtgt

SEQ ID NO: 365 - DNA, 47 bp, Homo Sapiens
  allele 24: 99-14596-174 : polymorphic base C or T
tttaatgcctttaatgacaatacycgttctttgtctccaaatgaggg

SEQ ID NO: 366 - DNA, 47 bp, Homo Sapiens
  allele 24: 99-14597-85 : polymorphic base G or C
acctgggacttcctagcatggctsaaaccaggttaggagtggggttg

SEQ ID NO: 367 - DNA, 47 bp, Homo Sapiens
  allele 24: 99-14598-91 : polymorphic base C or T
agagctcagtctaaggaattctcytttcattttacagtgtttctccc

SEQ ID NO: 368 - DNA, 47 bp, Homo Sapiens
  allele 24: 99-14599-220 : polymorphic base C or T
caggagagtgatttcagtgagatycacccaaaggcgggctggagcca

SEQ ID NO: 369 - DNA, 47 bp, Homo Sapiens
  allele 24: 99-14600-207 : polymorphic base A or G
tttttttatgtttatagctgaccrgcaatgtccctctatatttcttt

SEQ ID NO: 370 - DNA, 47 bp, Homo Sapiens
  allele 24: 99-14601-448 : polymorphic base C or T
acatatggccaatgtgagcaacayaggaaatactatttaatcctcta

SEQ ID NO: 371 - DNA, 47 bp, Homo Sapiens
  allele 24: 99-14607-267 : polymorphic base C or T
gggcttgaacattcatggagtgayggagagaatgacaaaatgtttgg

SEQ ID NO: 372 - DNA, 47 bp, Homo Sapiens
  allele 24: 99-14609-467 : polymorphic base G or T
ttggcttaagatttagagataggkatggaatagtaatttcatgagag

SEQ ID NO: 373 - DNA, 47 bp, Homo Sapiens
  allele 24: 99-14610-351 : polymorphic base A or C
tgaagggcatgttgacagcatgcmataaattctttggatttttacag

SEQ ID NO: 374 - DNA, 47 bp, Homo Sapiens
  allele 24: 99-14611-241 : polymorphic base G or C
catccagccaaccttatgggagastaagagcatgtactttcattcca

SEQ ID NO: 375 - DNA, 47 bp, Homo Sapiens
  allele 24: 99-14612-100 : polymorphic base G or C
agcaacgtgcatattgtggaggasagtttttgaagtgaagaagtgac

SEQ ID NO: 376 - DNA, 47 bp, Homo Sapiens
  allele 24: 99-14614-248 : polymorphic base A or G
aaacacttgacaattgctaaagcrcaacatggtttatgatatgccag

SEQ ID NO: 377 - DNA, 47 bp, Homo Sapiens
  allele 24: 99-14615-65 : polymorphic base A or G
ttggcaatttttttagagtcccartggtggtaaggcactgttctgag

SEQ ID NO: 378 - DNA, 47 bp, Homo Sapiens
  allele 24: 99-14616-35 : polymorphic base A or G
atgcctacagcagttagataggtrtcgggtgataattatagtgccgt

SEQ ID NO: 379 - DNA, 47 bp, Homo Sapiens
  allele 24: 99-14618-147 : polymorphic base G or C
ccagctttatcaatccacacttcsatattgcaggggctggcagagtg

SEQ ID NO: 380 - DNA, 47 bp, Homo Sapiens
  allele 24: 99-14619-325 : polymorphic base A or C
ctgaagcgattgttccagagcctmttttgagagccactgacatacag

SEQ ID NO: 381 - DNA, 47 bp, Homo Sapiens
  allele 24: 99-1462-238 : polymorphic base G or C
ccctttcaaggttagtaactcatstgctgtgtttctgcttcagaagg

SEQ ID NO: 382 - DNA, 47 bp, Homo Sapiens
  allele 24: 99-14620-253 : polymorphic base C or T
atcaataaatggtgtcagctatayaattgtgcacagcattgggagtg

SEQ ID NO: 383 - DNA, 47 bp, Homo Sapiens
  allele 24: 99-14621-96 : polymorphic base G or C
acagggatcccagataattcttcstgtggcagatagttcacaaacca

SEQ ID NO: 384 - DNA, 47 bp, Homo Sapiens
  allele 24: 99-14622-276 : polymorphic base C or T
gattactgtgtagaagtattgttycattaggatgtaagctataaatt

SEQ ID NO: 385 - DNA, 47 bp, Homo Sapiens
  allele 24: 99-14626-307 : polymorphic base A or G
tatcacttttcttaaatggtacaratgcctacatagaaaattcaaaa

SEQ ID NO: 386 - DNA, 47 bp, Homo Sapiens
  allele 24: 99-14627-272 : polymorphic base C or T
tacagcagatttttttatggataycttaaaaaaagaaaacaatagga

SEQ ID NO: 387 - DNA, 47 bp, Homo Sapiens
  allele 24: 99-14628-312 : polymorphic base A or C
atcattgccaaggtaattttaaamatttcactgtttgaagtcagaca

SEQ ID NO: 388 - DNA, 47 bp, Homo Sapiens
  allele 24: 99-14629-274 : polymorphic base A or G
acatgcttcaggcctggttagagrcagctcgggggatggctgtcata

SEQ ID NO: 389 - DNA, 47 bp, Homo Sapiens
  allele 24: 99-14630-75 : polymorphic base C or T
atccataaattaagtatgttgagycagaccaaaacaacacggagtat

SEQ ID NO: 390 - DNA, 47 bp, Homo Sapiens
  allele 24: 99-14634-350 : polymorphic base A or G
ctgttcttgtccttctcaaatacrctttgactagggtggccaggatc

SEQ ID NO: 391 - DNA, 47 bp, Homo Sapiens
  allele 24: 99-14635-296 : polymorphic base G or C
ctcattgcagttaaacttttcctstcaaatttcccactctgcaaagt

SEQ ID NO: 392 - DNA, 47 bp, Homo Sapiens
  allele 24: 99-14637-366 : polymorphic base G or C
caggatctagatgtagcaagaaasattatgtggaacaggacagaaac

SEQ ID NO: 393 - DNA, 47 bp, Homo Sapiens
  allele 24: 99-14638-276 : polymorphic base A or G
gcttttgaggtgcatgtgcaggargtaaggatacacacagggcgatg

SEQ ID NO: 394 - DNA, 47 bp, Homo Sapiens
  allele 24: 99-14643-27 : polymorphic base C or T
gcaattttaagccatagtaaaaaytaatattgcattttcctatgttt

SEQ ID NO: 395 - DNA, 47 bp, Homo Sapiens
  allele 24: 99-14644-395 : polymorphic base G or C
tttgcaaatgtctttctgagcctsaccaccctttctgtggtagccat

SEQ ID NO: 396 - DNA, 47 bp, Homo Sapiens
  allele 24: 99-14647-227 : polymorphic base C or T
cactcaggaactaaattagctctygcaatatacttttactacaatag

SEQ ID NO: 397 - DNA, 47 bp, Homo Sapiens
  allele 24: 99-14651-205 : polymorphic base A or G
ggataggtataccaggagagaacrtgtgagtgcaggaagcaatgtag

SEQ ID NO: 398 - DNA, 47 bp, Homo Sapiens
  allele 24: 99-14652-120 : polymorphic base A or G
attaatgtgagtatttctgtgatrgaaagtgtgtaatatgcatatac

SEQ ID NO: 399 - DNA, 47 bp, Homo Sapiens
  allele 24: 99-14653-138 : polymorphic base C or T
tacattaaaaaaacacagacagayatgcacgcacacactcgcacaca

SEQ ID NO: 400 - DNA, 47 bp, Homo Sapiens
  allele 24: 99-14662-352 : polymorphic base A or G
tatactgcaaaagtgaaggacatrgacgacttccatggagaaagaaa

SEQ ID NO: 401 - DNA, 47 bp, Homo Sapiens
  allele 24: 99-14664-289 : polymorphic base C or T
agtgcaggtagcatctagaaaccyaccatatatcatacaaggataat

SEQ ID NO: 402 - DNA, 47 bp, Homo Sapiens
  allele 24: 99-14665-199 : polymorphic base A or G
tattataactgtccaaaataactrctgaagtttttacatattaaagg

SEQ ID NO: 403 - DNA, 47 bp, Homo Sapiens
  allele 24: 99-14669-238 : polymorphic base A or G
ttacactgtgtgaggccctctatrttctgtgcttgtatcctcttgga

SEQ ID NO: 404 - DNA, 47 bp, Homo Sapiens
  allele 24: 99-14671-175 : polymorphic base C or T
tttcagatttatgtaacagatcayacttaaatcacaggatagggcta

SEQ ID NO: 405 - DNA, 47 bp, Homo Sapiens
  allele 24: 99-14676-313 : polymorphic base A or T
aagttcccatctacaaggtagatwtatacsctattattattatataa

SEQ ID NO: 406 - DNA, 47 bp, Homo Sapiens
  allele 24: 99-14677-358 : polymorphic base G or C
aaagagttaaacctgaaatattastagggaaagataacacagtatct

SEQ ID NO: 407 - DNA, 47 bp, Homo Sapiens
  allele 24: 99-14678-75 : polymorphic base G or C
aaattgcaagatgctaggaatttsaaggcaaactgcctataaaaata

SEQ ID NO: 408 - DNA, 47 bp, Homo Sapiens
  allele 24: 99-14679-241 : polymorphic base C or T
ctttcaattgcaaacaccgcaatyacttttgcagcgacctaataaca

SEQ ID NO: 409 - DNA, 47 bp, Homo Sapiens
  allele 24: 99-1468-435 : polymorphic base C or T
ccttgagacactggagcttctggyttcacccgtattaaagcaagagt

SEQ ID NO: 410 - DNA, 47 bp, Homo Sapiens
  allele 24: 99-1469-47 : polymorphic base G or C
attttgtctcctgcctagaactgsactaatatgttgcttgtagattt

SEQ ID NO: 411 - DNA, 47 bp, Homo Sapiens
  allele 24: 99-14690-84 : polymorphic base G or T
ctatgttaaagttttaaggtaaakgtagatgacacacagatagatag

SEQ ID NO: 412 - DNA, 47 bp, Homo Sapiens
  allele 24: 99-14692-46 : polymorphic base A or G
aatcaaaactcactaaacatgtarcttccaaagcacacaaatcaggt

SEQ ID NO: 413 - DNA, 47 bp, Homo Sapiens
  allele 24: 99-14699-149 : polymorphic base C or T
gaattgtggatgtaaaattgttaygtcatttggataacggcactggc

SEQ ID NO: 414 - DNA, 47 bp, Homo Sapiens
  allele 24: 99-147-181 : polymorphic base A or G
gtgtcatgaaaaagagcatgataraaagaaaaacttaaatctttata

SEQ ID NO: 415 - DNA, 47 bp, Homo Sapiens
  allele 24: 99-14701-264 : polymorphic base A or G
ggcattctctttacttaaggcttrcattcataataatgttggccaag

SEQ ID NO: 416 - DNA, 47 bp, Homo Sapiens
  allele 24: 99-14704-59 : polymorphic base A or C
ctccatacccctcacttgacactmaatcgcagacacatcatacaaac

SEQ ID NO: 417 - DNA, 47 bp, Homo Sapiens
  allele 24: 99-14708-142 : polymorphic base G or T
acaaagaagtgagaaagtggatgkccagtataatgttctgactcagc

SEQ ID NO: 418 - DNA, 47 bp, Homo Sapiens
  allele 24: 99-1471-571 : polymorphic base C or T
ttcaactgatatgtgctatgtgayatgaataccaaaattgtgaggac

SEQ ID NO: 419 - DNA, 47 bp, Homo Sapiens
  allele 24: 99-14710-107 : polymorphic base C or T
tggttattgaatctcgagccagtygcagcaggcagtcctgaccttga

SEQ ID NO: 420 - DNA, 47 bp, Homo Sapiens
  allele 24: 99-14712-163 : polymorphic base C or T
ccatatttgactatattgcaaaaycaactgcaagacaaatttcaact

SEQ ID NO: 421 - DNA, 47 bp, Homo Sapiens
  allele 24: 99-14714-237 : polymorphic base C or T
  misc_feature 40: n=a, g, c or t
ttttagtaagtcatttcctgaaaytatccattgcatctgncaactca

SEQ ID NO: 422 - DNA, 47 bp, Homo Sapiens
  allele 24: 99-14717-132 : polymorphic base A or G
agacaggcaaaaaaccaattccaraaagttatactggcaaaaccaca

SEQ ID NO: 423 - DNA, 47 bp, Homo Sapiens
  allele 24: 99-1472-435 : polymorphic base A or G
accactgctttccctgcttccctrtgagtgtgcacagagatttaatt

SEQ ID NO: 424 - DNA, 47 bp, Homo Sapiens
  allele 24: 99-14722-272 : polymorphic base C or T
ttcatcacgagagcacggaaagayaagctgtccgatatgtttgtaag

SEQ ID NO: 425 - DNA, 47 bp, Homo Sapiens
  allele 24: 99-14729-284 : polymorphic base A or T
tactggatttcccaaatggttgcwagatgggatcatcagaggcaaag

SEQ ID NO: 426 - DNA, 47 bp, Homo Sapiens
  allele 24: 99-14733-26 : polymorphic base A or T
caccacttaaactgaactttcttwagtaaacagtttaacttttctta

SEQ ID NO: 427 - DNA, 47 bp, Homo Sapiens
  allele 24: 99-14735-328 : polymorphic base A or G
gagcacagtaatatttatacatgrgtatagtgtgtatacatgtgtgt

SEQ ID NO: 428 - DNA, 47 bp, Homo Sapiens
  allele 24: 99-1474-156 : polymorphic base G or T
cttgtactcataagttaaatattkataacaagaagaaatatggactt

SEQ ID NO: 429 - DNA, 47 bp, Homo Sapiens
  allele 24: 99-14746-377 : polymorphic base A or G
ataatttatcacattagatcaccrtgagaataagaccacgaattggc

SEQ ID NO: 430 - DNA, 47 bp, Homo Sapiens
  allele 24: 99-14753-194 : polymorphic base G or T
tattcccttgtgagtgcctgtcakgtagtgactttatgtaagcacat

SEQ ID NO: 431 - DNA, 47 bp, Homo Sapiens
  allele 24: 99-14756-270 : polymorphic base A or T
ctaaatgaccaactcctgatttawtttcttgccacctgcaatctgca

SEQ ID NO: 432 - DNA, 47 bp, Homo Sapiens
  allele 24: 99-1476-172 : polymorphic base G or C
gtcaatttcaaaggtgtttgacascattaagatggcacgtaagtctc

SEQ ID NO: 433 - DNA, 47 bp, Homo Sapiens
  allele 24: 99-14761-194 : polymorphic base A or G
aatacggaggaagggatctccatrtagaaagaattaaagttaaaacc

SEQ ID NO: 434 - DNA, 47 bp, Homo Sapiens
  allele 24: 99-14773-383 : polymorphic base G or T
aagatgctgaaggtctggccaatkatggcacaagtctatgactgtag

SEQ ID NO: 435 - DNA, 47 bp, Homo Sapiens
  allele 24: 99-14776-79 : polymorphic base G or C
aaaatcaagttttgtggaaaaatsatcaaaacaatggggatatcata

SEQ ID NO: 436 - DNA, 47 bp, Homo Sapiens
  allele 24: 99-14777-100 : polymorphic base C or T
tactgcttttaaaaaatgtgttaygtttcaggtatacactgggatga

SEQ ID NO: 437 - DNA, 47 bp, Homo Sapiens
  allele 24: 99-14782-152 : polymorphic base G or C
gctctggggtgcacaggcctcccscaaacagcgatacgttagtaaag

SEQ ID NO: 438 - DNA, 47 bp, Homo Sapiens
  allele 24: 99-14784-212 : polymorphic base A or G
gcaactgacgtgcagctccacaartccgtcagcctttccaagcctcc

SEQ ID NO: 439 - DNA, 47 bp, Homo Sapiens
  allele 24: 99-14785-92 : polymorphic base A or C
gtttgcctcacacattctaaatgmtattccccragatggctttgtag

SEQ ID NO: 440 - DNA, 47 bp, Homo Sapiens
  allele 24: 99-14786-59 : polymorphic base A or G
gtaagcaaataattgcacaaaggrtaaataaatgcaaaatcaagcct

SEQ ID NO: 441 - DNA, 47 bp, Homo Sapiens
  allele 24: 99-1479-158 : polymorphic base C or T
tttaaaaatccacttgtaatcgcygctaattggagtgtatattcagg

SEQ ID NO: 442 - DNA, 47 bp, Homo Sapiens
  allele 24: 99-14792-43 : polymorphic base C or T
ggtttataataagaggtaaccatygcagctatgttaacataaggaat

SEQ ID NO: 443 - DNA, 47 bp, Homo Sapiens
  allele 24: 99-14796-227 : polymorphic base C or T
agcagcccattatgagtttctcaygttggaccaggttggtgtggttt

SEQ ID NO: 444 - DNA, 47 bp, Homo Sapiens
  allele 24: 99-14799-57 : polymorphic base A or G
  misc_feature 34: n=a, g, c or t
acccgggccttactcctgtctccrttgcctcctntatgtatgatctc

SEQ ID NO: 445 - DNA, 47 bp, Homo Sapiens
  allele 24: 99-148-182 : polymorphic base A or G
ttgatgttgatatgggcaactgtrtgttggatggtcccaaagcattc

SEQ ID NO: 446 - DNA, 47 bp, Homo Sapiens
  allele 24: 99-1480-290 : polymorphic base G or T
tgcaccatcttcaccacaacccckggcaaccactgatccttttactg

SEQ ID NO: 447 - DNA, 47 bp, Homo Sapiens
  allele 24: 99-14802-60 : polymorphic base A or T
taaagccttcccttaaagtgtcawtccagacatggctgtaagaccaa

SEQ ID NO: 448 - DNA, 47 bp, Homo Sapiens
  allele 24: 99-14803-157 : polymorphic base C or T
ttaaccttatttccatggccaaayggcaatacctctaaacaccttca

SEQ ID NO: 449 - DNA, 47 bp, Homo Sapiens
  allele 24: 99-14804-216 : polymorphic base A or G
ataattaaccagtaattaagtctrtaaaaatgcattttactttgagt

SEQ ID NO: 450 - DNA, 47 bp, Homo Sapiens
  allele 24: 99-14805-58 : polymorphic base A or G
aacatgttgtgggttttctctgtragttggttggtagcatgtcattg

SEQ ID NO: 451 - DNA, 47 bp, Homo Sapiens
  allele 24: 99-14806-108 : polymorphic base G or C
ctcttaccaatcttgttagttgtstgtctcgccatgaaaaccgtatc

SEQ ID NO: 452 - DNA, 47 bp, Homo Sapiens
  allele 24: 99-14807-150 : polymorphic base G or C
ggtatcactatttttctctgagasagaacccacacagttatcttttg

SEQ ID NO: 453 - DNA, 47 bp, Homo Sapiens
  allele 24: 99-1481-285 : polymorphic base G or T
tcccataacctgttttgcttctckctctaacctcaagatggtataaa

SEQ ID NO: 454 - DNA, 47 bp, Homo Sapiens
  allele 24: 99-14810-407 : polymorphic base C or T
cctctcaagtgtaataggcaaaayttcaaggtctgtacctaaaattt

SEQ ID NO: 455 - DNA, 47 bp, Homo Sapiens
  allele 24: 99-14812-189 : polymorphic base G or C
agtgaactgcacgtgtggcactasggtcttctgttgaaatgcctctg

SEQ ID NO: 456 - DNA, 47 bp, Homo Sapiens
  allele 24: 99-14817-323 : polymorphic base C or T
ttccaagatatggttattctgggyatgagtcactataacctgctagg

SEQ ID NO: 457 - DNA, 47 bp, Homo Sapiens
  allele 24: 99-14818-430 : polymorphic base A or G
tagtacaaataaaattcaattgcrttgcaagactggaatttggcaaa

SEQ ID NO: 458 - DNA, 47 bp, Homo Sapiens
  allele 24: 99-14819-278 : polymorphic base G or C
aagaaaaacactgtgagttgttcscccaaccctaaataaatagagta

SEQ ID NO: 459 - DNA, 47 bp, Homo Sapiens
  allele 24: 99-14820-76 : polymorphic base A or T
ttaatgaacaaaagaacaaatagwtaaatggaaagttatgacgtcat

SEQ ID NO: 460 - DNA, 47 bp, Homo Sapiens
  allele 24: 99-14821-48 : polymorphic base C or T
aataaagatgtcatacaatttatyttgttctctggccattctgagag

SEQ ID NO: 461 - DNA, 47 bp, Homo Sapiens
  allele 24: 99-14826-238 : polymorphic base G or T
gtttctctgttatctgagataaakggggattttcttcaagatgccaa

SEQ ID NO: 462 - DNA, 47 bp, Homo Sapiens
  allele 24: 99-14828-214 : polymorphic base C or T
gttaatattttgttttgagactayaattattatcataaaactcatga

SEQ ID NO: 463 - DNA, 47 bp, Homo Sapiens
  allele 24: 99-14833-226 : polymorphic base A or T
aggacctgatacacatttaacgawgacgatttacaagacaattttag

SEQ ID NO: 464 - DNA, 47 bp, Homo Sapiens
  allele 24: 99-1484-328 : polymorphic base G or C
ggacacgtggtcatgaggagtttsaagggattcagttttcagatccc

SEQ ID NO: 465 - DNA, 47 bp, Homo Sapiens
  allele 24: 99-14843-195 : polymorphic base G or T
ataataaggaacattatgcatgtkttacaaagaatgagccagaattt

SEQ ID NO: 466 - DNA, 47 bp, Homo Sapiens
  allele 24: 99-14844-143 : polymorphic base C or T
ggagatctttgcagaaaggtccgyggagcgacgtatatttgaaaaac

SEQ ID NO: 467 - DNA, 47 bp, Homo Sapiens
  allele 24: 99-1485-251 : polymorphic base G or T
  misc_feature 44: n=a, g, c or t
gattgccttgatatatgctcccakagaaccaagaatgtcccctnttc

SEQ ID NO: 468 - DNA, 47 bp, Homo Sapiens
  allele 24: 99-14850-136 : polymorphic base A or G
ggactaatgtccccacatagttaragaagaatgagattcaagagcta

SEQ ID NO: 469 - DNA, 47 bp, Homo Sapiens
  allele 24: 99-14856-260 : polymorphic base A or G
gggagctggtgaactttgtttccrtactgttacgcttggtttaatac

SEQ ID NO: 470 - DNA, 47 bp, Homo Sapiens
  allele 24: 99-14861-387 : polymorphic base A or G
aatagaacgtgcctctaggtgctratttactgtcctggcacaatccc

SEQ ID NO: 471 - DNA, 47 bp, Homo Sapiens
  allele 24: 99-14862-171 : polymorphic base A or T
ttcctcatttttatgtagaagccwggcctggcttggctaagagcctt

SEQ ID NO: 472 - DNA, 47 bp, Homo Sapiens
  allele 24: 99-14865-386 : polymorphic base A or G
aataggtagcacatgtttttagtrgtaatgtaaatgcatattgtaat

SEQ ID NO: 473 - DNA, 47 bp, Homo Sapiens
  allele 24: 99-14867-160 : polymorphic base A or T
cctcccaaggctgttgtgagccawacataacttctgtcatttgacag

SEQ ID NO: 474 - DNA, 47 bp, Homo Sapiens
  allele 24: 99-14872-326 : polymorphic base A or G
ttaagaaaagaaacagcagaaatrttcaagttagcaaaaaaccaaca

SEQ ID NO: 475 - DNA, 47 bp, Homo Sapiens
  allele 24: 99-14873-453 : polymorphic base C or T
atattacatattcctaataggaaygcagagtggcacgtcatgttggc

SEQ ID NO: 476 - DNA, 47 bp, Homo Sapiens
  allele 24: 99-14875-411 : polymorphic base C or T
aattagtgttattaaaagaaaagygtgtcaatgtggtctttttgtag

SEQ ID NO: 477 - DNA, 47 bp, Homo Sapiens
  allele 24: 99-14879-398 : polymorphic base G or C
cctcagtgttcttatggggttttscctcattccctttaatccttgct

SEQ ID NO: 478 - DNA, 47 bp, Homo Sapiens
  allele 24: 99-14881-231 : polymorphic base C or T
catggtgctattcagagcagtacygcttggccactttggaattcgta

SEQ ID NO: 479 - DNA, 47 bp, Homo Sapiens
  allele 24: 99-14882-382 : polymorphic base G or C
ttgagattactagatccagactastccagaagagtaggtcaaagatg

SEQ ID NO: 480 - DNA, 47 bp, Homo Sapiens
  allele 24: 99-14883-123 : polymorphic base G or C
agtccacaaccctctcttcacacsctttcttcaagtaccctgagtca

SEQ ID NO: 481 - DNA, 47 bp, Homo Sapiens
  allele 24: 99-1489-76 : polymorphic base A or C
caacattcatgtcattaaaagcamttatctggagcaattatccaact

SEQ ID NO: 482 - DNA, 47 bp, Homo Sapiens
  allele 24: 99-14890-358 : polymorphic base G or T
aacaagctatcatgcatctgtatkaggagcatggttacactcacagg

SEQ ID NO: 483 - DNA, 47 bp, Homo Sapiens
  allele 24: 99-14892-237 : polymorphic base A or G
tgaatacttgctactcacattttrtgtacactacattatctcttccc

SEQ ID NO: 484 - DNA, 47 bp, Homo Sapiens
  allele 24: 99-14894-52 : polymorphic base A or G
ggagctttaagaacacttattctratagaaacctgtttcatcaaaat

SEQ ID NO: 485 - DNA, 47 bp, Homo Sapiens
  allele 24: 99-14895-343 : polymorphic base C or T
catttatctttccttccaaattaytacagacatacagggattttcca

SEQ ID NO: 486 - DNA, 47 bp, Homo Sapiens
  allele 24: 99-14897-356 : polymorphic base C or T
tttttgtctaattaaaaaaataaygatgtatatagcgttttgctgtt

SEQ ID NO: 487 - DNA, 47 bp, Homo Sapiens
  allele 24: 99-1490-381 : polymorphic base C or T
tgcacagtggaaataccatgtcayggtacgctactgtgcatctcttc

SEQ ID NO: 488 - DNA, 47 bp, Homo Sapiens
  allele 24: 99-14907-411 : polymorphic base G or T
atacagagaagattagcatggctkctgtgcaagaataatatgcaaat

SEQ ID NO: 489 - DNA, 47 bp, Homo Sapiens
  allele 24: 99-1493-280 : polymorphic base A or G
ggatgacagagtattgttggaggratggggtttggctgcttgttttt

SEQ ID NO: 490 - DNA, 47 bp, Homo Sapiens
  allele 24: 99-14937-42 : polymorphic base A or C
cacctggcaaatttcacacacacmaacccattatgtaagacgcagac

SEQ ID NO: 491 - DNA, 47 bp, Homo Sapiens
  allele 24: 99-14939-240 : polymorphic base A or C
ggaggaagaaagtgtgggaagaamcttaagtggtaacaggagcttgc

SEQ ID NO: 492 - DNA, 47 bp, Homo Sapiens
  allele 24: 99-1494-598 : polymorphic base A or G
cccccacatggtctgactcccagragccccttttcctggttcctctg

SEQ ID NO: 493 - DNA, 47 bp, Homo Sapiens
  allele 24: 99-14940-224 : polymorphic base A or G
aactccagctacttaataaggggrtgaccttgggcaagtgacttaat

SEQ ID NO: 494 - DNA, 47 bp, Homo Sapiens
  allele 24: 99-14950-346 : polymorphic base A or T
tttcccttgatctttttctctttwgcttataaataatgggatgctca

SEQ ID NO: 495 - DNA, 47 bp, Homo Sapiens
  allele 24: 99-14959-81 : polymorphic base A or T
caggtggtatttaaagtcatgagwctgaatgagaatgttaggggagc

SEQ ID NO: 496 - DNA, 47 bp, Homo Sapiens
  allele 24: 99-14961-193 : polymorphic base G or C
cctatggttttctatgtcctaatsagcaactgaaacgatacatatct

SEQ ID NO: 497 - DNA, 47 bp, Homo Sapiens
  allele 24: 99-14962-120 : polymorphic base A or G
gggagaaaatatttgcaaaacacrtatctgataaaggactggtatcc

SEQ ID NO: 498 - DNA, 47 bp, Homo Sapiens
  allele 24: 99-14966-187 : polymorphic base A or G
gagtaatctctatacatcctcagrcctaaagagacaaaaaagctcaa

SEQ ID NO: 499 - DNA, 47 bp, Homo Sapiens
  allele 24: 99-14970-352 : polymorphic base A or G
gcattagattcttctgtttttatrtggtgtccttgcatgaccctttg

SEQ ID NO: 500 - DNA, 47 bp, Homo Sapiens
  allele 24: 99-14978-200 : polymorphic base G or T
tttgaaacctgctcattcctatgkggctgatgtcaaatagcaagatt

SEQ ID NO: 501 - DNA, 47 bp, Homo Sapiens
  allele 24: 99-1498-120 : polymorphic base C or T
ccactacaaatatacctctggacyctcttctgagctcctggccaact

SEQ ID NO: 502 - DNA, 47 bp, Homo Sapiens
  allele 24: 99-14983-186 : polymorphic base G or T
atgatataaactgcagggagattktatccaaaaaattcttttaggtg

SEQ ID NO: 503 - DNA, 47 bp, Homo Sapiens
  allele 24: 99-14984-35 : polymorphic base C or T
acagaacaatcttccaaggtagaygagggctgtcttttaggcaagga

SEQ ID NO: 504 - DNA, 47 bp, Homo Sapiens
  allele 24: 99-15005-169 : polymorphic base C or T
cattcagactttgtccatagtggycactcaggaaatctcaggtaaca

SEQ ID NO: 505 - DNA, 47 bp, Homo Sapiens
  allele 24: 99-15007-369 : polymorphic base A or G
ggtgtttatgccttgttaggtgarttcaatattactgattattcctt

SEQ ID NO: 506 - DNA, 47 bp, Homo Sapiens
  allele 24: 99-1501-296 : polymorphic base A or G
tccrttgacttgtataattatccrattgctctgcacaacaaagtccc

SEQ ID NO: 507 - DNA, 47 bp, Homo Sapiens
  allele 24: 99-15016-293 : polymorphic base C or T
ttctcagctgagcttatcccaccytctgatgcaatagaaatctcagg

SEQ ID NO: 508 - DNA, 47 bp, Homo Sapiens
  allele 24: 99-15018-270 : polymorphic base A or G
agaaggaatagggtatgactaccragaggtatgtgtttcttttgcag

SEQ ID NO: 509 - DNA, 47 bp, Homo Sapiens
  allele 24: 99-15019-408 : polymorphic base A or G
tttctaaggttattttacctaacrcttaattgattattttgtaaggt

SEQ ID NO: 510 - DNA, 47 bp, Homo Sapiens
  allele 24: 99-15021-189 : polymorphic base A or G
tatgccccttaactgaacatttarctatctcttctggaagtgttctt

SEQ ID NO: 511 - DNA, 47 bp, Homo Sapiens
  allele 24: 99-15030-271 : polymorphic base A or C
tcaaaactcaactgttcatccccmtacctgcaattaatatattctca

SEQ ID NO: 512 - DNA, 47 bp, Homo Sapiens
  allele 24: 99-15039-277 : polymorphic base G or T
tgcccctagaccttcagctgtgckcccttaggtatatggcgaaagca

SEQ ID NO: 513 - DNA, 47 bp, Homo Sapiens
  allele 24: 99-1504-252 : polymorphic base A or G
agtattctagttggccaaccacaraaattgtaggctgacataaaata

SEQ ID NO: 514 - DNA, 47 bp, Homo Sapiens
  allele 24: 99-15043-175 : polymorphic base A or G
acatggcccaagtctggtcaatcrgggtgatttctgcgctttgcaag

SEQ ID NO: 515 - DNA, 47 bp, Homo Sapiens
  allele 24: 99-15046-54 : polymorphic base C or T
caattcacccagaaaaggcctctygtctaaaggctccatatttcagg

SEQ ID NO: 516 - DNA, 47 bp, Homo Sapiens
  allele 24: 99-1506-505 : polymorphic base C or T
  misc_feature 8: n=a, g, c or t
aatctggncagatctcagataaayagcaaaaggaagagagaaggtcc

SEQ ID NO: 517 - DNA, 47 bp, Homo Sapiens
  allele 24: 99-15072-64 : polymorphic base C or T
agatacagtgatgatcccatctcycccaccatcttgaattttgtgtg

SEQ ID NO: 518 - DNA, 47 bp, Homo Sapiens
  allele 24: 99-15087-77 : polymorphic base C or T
gaaaagatgagccactgcagaacyatagaatcgaaacctagtttttt

SEQ ID NO: 519 - DNA, 47 bp, Homo Sapiens
  allele 24: 99-15098-367 : polymorphic base C or T
agaacacagattcagcagggcatyatggcttgtgctacccaggctgg

SEQ ID NO: 520 - DNA, 47 bp, Homo Sapiens
  allele 24: 99-151-94 : polymorphic base A or G
attgagatcattgataaggaaatrttctaaaatttcaaaatctatat

SEQ ID NO: 521 - DNA, 47 bp, Homo Sapiens
  allele 24: 99-15100-363 : polymorphic base C or T
ccaagcaggtgtttgagccagacycccatgcaagcagggacaggacc

SEQ ID NO: 522 - DNA, 47 bp, Homo Sapiens
  allele 24: 99-15101-154 : polymorphic base G or C
agttaaaaagagaagaggtagtgsctggagaacgggaggcttgacgt

SEQ ID NO: 523 - DNA, 47 bp, Homo Sapiens
  allele 24: 99-15106-451 : polymorphic base C or T
ccaaggccaggattctgtgcctcygcccccctccccacctccttgaa

SEQ ID NO: 524 - DNA, 47 bp, Homo Sapiens
  allele 24: 99-15107-228 : polymorphic base A or G
actctgtagtcattaatgaaccarccacaagcttgtctccttcttca

SEQ ID NO: 525 - DNA, 47 bp, Homo Sapiens
  allele 24: 99-15112-358 : polymorphic base C or T
ctacgtgtatcatgagcaagaaayacattgatgacgtaacaactgag

SEQ ID NO: 526 - DNA, 47 bp, Homo Sapiens
  allele 24: 99-15118-69 : polymorphic base A or G
acaggaaggagcttcccttatcartgctagacctggtcttaggcatt

SEQ ID NO: 527 - DNA, 47 bp, Homo Sapiens
  allele 24: 99-15123-180 : polymorphic base C or T
aattccaggtgatatttgtaaaayataagctaaaattgttcatgcaa

SEQ ID NO: 528 - DNA, 47 bp, Homo Sapiens
  allele 24: 99-15128-349 : polymorphic base C or T
aaaccctggcctcaagcaatcctyccgcctcggcctcccaaagtgct

SEQ ID NO: 529 - DNA, 47 bp, Homo Sapiens
  allele 24: 99-15129-279 : polymorphic base C or T
gtgatctaaatattaaccagtagygcacattataaacacttacttac

SEQ ID NO: 530 - DNA, 47 bp, Homo Sapiens
  allele 24: 99-15135-231 : polymorphic base A or G
catgtccttggccaaggccaaagrcaccttgatcacttgttagtgag

SEQ ID NO: 531 - DNA, 47 bp, Homo Sapiens
  allele 24: 99-15137-386 : polymorphic base A or G
ctcaccatgcacgtcaacacacartcccttttgggatagaaagtgat

SEQ ID NO: 532 - DNA, 47 bp, Homo Sapiens
  allele 24: 99-1515-402 : polymorphic base A or G
tattaaaatatccctgatgaaacrtatttcttaaaaccactaagaaa

SEQ ID NO: 533 - DNA, 47 bp, Homo Sapiens
  allele 24: 99-15160-270 : polymorphic base A or G
atctttaacaagragttgtgactrattttttctttacaagtcaaaag

SEQ ID NO: 534 - DNA, 47 bp, Homo Sapiens
  allele 24: 99-15164-67 : polymorphic base C or T
tgaaaagccagaaacttagaactyaaatagtgctataccagtccgtt

SEQ ID NO: 535 - DNA, 47 bp, Homo Sapiens
  allele 24: 99-15193-143 : polymorphic base G or T
tcagatgctaaaagtgaaacctgkaggggtgatataagatgtccaaa

SEQ ID NO: 536 - DNA, 47 bp, Homo Sapiens
  allele 24: 99-15195-377 : polymorphic base A or C
ctttcattggttttggtagcaaamtaaacctttgctttttatgtaat

SEQ ID NO: 537 - DNA, 47 bp, Homo Sapiens
  allele 24: 99-15199-179 : polymorphic base C or T
tgtatcaagaggctgctgtaaatyaggaatctgctagatgctagaca

SEQ ID NO: 538 - DNA, 47 bp, Homo Sapiens
  allele 24: 99-1520-143 : polymorphic base C or T
tcagctcacgacaacctccgcctyctgggttcaagcaattctcctgc

SEQ ID NO: 539 - DNA, 47 bp, Homo Sapiens
  allele 24: 99-15200-196 : polymorphic base A or G
ccagagagagacttgggtgtaatrttacagagcagagctaacattac

SEQ ID NO: 540 - DNA, 47 bp, Homo Sapiens
  allele 24: 99-15202-357 : polymorphic base G or C
tctggtaagatgaaatctgccatsgtgggaggatttacaccacagaa

SEQ ID NO: 541 - DNA, 47 bp, Homo Sapiens
  allele 24: 99-1521-457 : polymorphic base G or C
aattgaagagtcatggataatgtsaaaattctgcaattttagattaa

SEQ ID NO: 542 - DNA, 47 bp, Homo Sapiens
  allele 24: 99-1525-102 : polymorphic base C or T
gtcctaccctccaactagtaataytaccagcagttctttccttagct

SEQ ID NO: 543 - DNA, 47 bp, Homo Sapiens
  allele 24: 99-15290-343 : polymorphic base G or T
tgagaagcctagaggacgtggtgktaagctgaggcagacaagttcta

SEQ ID NO: 544 - DNA, 47 bp, Homo Sapiens
  allele 24: 99-15296-326 : polymorphic base G or C
gtggtgacatgcagaagtgcaggsagtcagccacctcacaggggcaa

SEQ ID NO: 545 - DNA, 47 bp, Homo Sapiens
  allele 24: 99-15302-371 : polymorphic base G or T
gcccagataattggacataactckgcccataaggtgccctctaataa

SEQ ID NO: 546 - DNA, 47 bp, Homo Sapiens
  allele 24: 99-15307-251 : polymorphic base C or T
ggatctgccaaaattagtgacccytcccatgccttccttagaacata

SEQ ID NO: 547 - DNA, 47 bp, Homo Sapiens
  allele 24: 99-15310-385 : polymorphic base A or G
aactcctcagaagccacaaagctrgtaactgcaacatggtctactac

SEQ ID NO: 548 - DNA, 47 bp, Homo Sapiens
  allele 24: 99-15325-95 : polymorphic base A or G
gagcacacgtgtgcacagaggaaragctaagttactctttgttcata

SEQ ID NO: 549 - DNA, 47 bp, Homo Sapiens
  allele 24: 99-15328-328 : polymorphic base C or T
tattacttgttacattatctttgyctcagttgaaatcagttagtagt

SEQ ID NO: 550 - DNA, 47 bp, Homo Sapiens
  allele 24: 99-1533-471 : polymorphic base G or T
tctctgtgaggttagtgggaacckcttggataagcctattgggatta

SEQ ID NO: 551 - DNA, 47 bp, Homo Sapiens
  allele 24: 99-15330-301 : polymorphic base G or C
tccagatgttttaaagaatctttscaggtgggcctatattatgttat

SEQ ID NO: 552 - DNA, 47 bp, Homo Sapiens
  allele 24: 99-15335-313 : polymorphic base A or G
atttttcacatcttaaactctgartgaatactaagaataattcttac

SEQ ID NO: 553 - DNA, 47 bp, Homo Sapiens
  allele 24: 99-15339-378 : polymorphic base C or T
attgacaattcgtgaagaaattcyaaaaaaaataaagatcacttaaa

SEQ ID NO: 554 - DNA, 47 bp, Homo Sapiens
  allele 24: 99-15345-376 : polymorphic base G or T
cctggaagtgtctgtgtagcgggktgcttttcctccattagtgtttg

SEQ ID NO: 555 - DNA, 47 bp, Homo Sapiens
  allele 24: 99-1535-241 : polymorphic base C or T
catataaaatgtacgtgactgtgytaattatattaacataataatgt

SEQ ID NO: 556 - DNA, 47 bp, Homo Sapiens
  allele 24: 99-1537-243 : polymorphic base G or T
tcagtcaatttctttatttaagakcctcataatctgtcctgagcatt

SEQ ID NO: 557 - DNA, 47 bp, Homo Sapiens
  allele 24: 99-15374-99 : polymorphic base A or G
ctttatataaagagggtcttgctrtgttgcccaggctggtctcgaac

SEQ ID NO: 558 - DNA, 47 bp, Homo Sapiens
  allele 24: 99-15377-206 : polymorphic base A or G
ctcttaaggaaaaaagaagtaacracatgacaaccagtaattttcta

SEQ ID NO: 559 - DNA, 47 bp, Homo Sapiens
  allele 24: 99-15382-388 : polymorphic base G or T
tttcgaattttgaaaataattttkggacgcagcgtatggtcaggcaa

SEQ ID NO: 560 - DNA, 47 bp, Homo Sapiens
  allele 24: 99-15393-177 : polymorphic base A or T
gtagagagacagattcctagaatwgctctcatgttaattttgaagtt

SEQ ID NO: 561 - DNA, 47 bp, Homo Sapiens
  allele 24: 99-15406-220 : polymorphic base A or C
tacatctgggtcaatggatatacmtgccaaacaggtaagttacattg

SEQ ID NO: 562 - DNA, 47 bp, Homo Sapiens
  allele 24: 99-15425-132 : polymorphic base C or T
taatgtgaaatttctattttctayttatatataaatattatggctta

SEQ ID NO: 563 - DNA, 47 bp, Homo Sapiens
  allele 24: 99-15441-337 : polymorphic base A or C
gaaagtaggtaagcttatgacttmaggtgaaaaaaatttttagtgag

SEQ ID NO: 564 - DNA, 47 bp, Homo Sapiens
  allele 24: 99-15446-339 : polymorphic base A or G
attccaaattcctttccggtggcrtccatctgctgtgcaaaatgttg

SEQ ID NO: 565 - DNA, 47 bp, Homo Sapiens
  allele 24: 99-15457-171 : polymorphic base A or C
tacatcttatttgcaatcattcamccactaactttttttaatgctta

SEQ ID NO: 566 - DNA, 47 bp, Homo Sapiens
  allele 24: 99-15458-308 : polymorphic base C or T
tgcagctctctctgcaccactacyttttcctgtgaatcccatccatt

SEQ ID NO: 567 - DNA, 47 bp, Homo Sapiens
  allele 24: 99-15473-339 : polymorphic base A or C
ttctatttatacagctaaatatamgtttataattagaaaataaaatt

SEQ ID NO: 568 - DNA, 47 bp, Homo Sapiens
  allele 24: 99-15486-309 : polymorphic base A or C
atttatcctcatgcaccacactgmcacttacagtacagctcttaatt

SEQ ID NO: 569 - DNA, 47 bp, Homo Sapiens
  allele 24: 99-15489-305 : polymorphic base G or C
ttgcctgttactaatgacatagasaaagctaaaattttatttttgag

SEQ ID NO: 570 - DNA, 47 bp, Homo Sapiens
  allele 24: 99-1549-124 : polymorphic base A or G
aaagcaatgctcagggaagttaartgacctgtaaaattcagatattt

SEQ ID NO: 571 - DNA, 47 bp, Homo Sapiens
  allele 24: 99-15490-398 : polymorphic base A or C
cccataaaatgtgtcatctattamttttgtgaaaatttgctgataca

SEQ ID NO: 572 - DNA, 47 bp, Homo Sapiens
  allele 24: 99-15493-197 : polymorphic base A or G
tacctacttcttgtctctaaaggrgattgaaaataatttctctgaat

SEQ ID NO: 573 - DNA, 47 bp, Homo Sapiens
  allele 24: 99-15500-77 : polymorphic base A or G
ggaattttaaccacatcttctccracatgatgtcaaaaaatacactt

SEQ ID NO: 574 - DNA, 47 bp, Homo Sapiens
  allele 24: 99-15502-250 : polymorphic base G or C
gtactcaagacaaacatatttaascacgtttgttactgtcacttgat

SEQ ID NO: 575 - DNA, 47 bp, Homo Sapiens
  allele 24: 99-15503-85 : polymorphic base G or T
gtgtggttaatttccacgtctttkcccttcccaacttctttccctct

SEQ ID NO: 576 - DNA, 47 bp, Homo Sapiens
  allele 24: 99-15507-248 : polymorphic base C or T
taacagacagcataagcatgtccytaaaacaattctttgtgtgttat

SEQ ID NO: 577 - DNA, 47 bp, Homo Sapiens
  allele 24: 99-15508-259 : polymorphic base C or T
tggttctgcacaattcatctaaayacttggatcaactaacctcaata

SEQ ID NO: 578 - DNA, 47 bp, Homo Sapiens
  allele 24: 99-15511-278 : polymorphic base A or G
agaaaaaacgttcataagatttgrtaaagtttaaaatgtccattact

SEQ ID NO: 579 - DNA, 47 bp, Homo Sapiens
  allele 24: 99-15516-155 : polymorphic base A or G
tttttaaccacaatctattactgrtcttctggtaaactgcattcctt

SEQ ID NO: 580 - DNA, 47 bp, Homo Sapiens
  allele 24: 99-15524-224 : polymorphic base C or T
actctgattcgatgggtctacagygaggttctgcatttttaacaacc

SEQ ID NO: 581 - DNA, 47 bp, Homo Sapiens
  allele 24: 99-15526-324 : polymorphic base A or T
ttaatagcccttaattcccccttwtaatgagatatctgcattcgact

SEQ ID NO: 582 - DNA, 47 bp, Homo Sapiens
  allele 24: 99-15527-154 : polymorphic base A or G
cagcattgaatcttatttcctcaratgaagatagttcatctcaaatg

SEQ ID NO: 583 - DNA, 47 bp, Homo Sapiens
  allele 24: 99-15528-333 : polymorphic base A or G
gattccatggtaccatgttgagarttgtgcctagctactgagagtct

SEQ ID NO: 584 - DNA, 47 bp, Homo Sapiens
  allele 24: 99-1553-544 : polymorphic base A or C
actcctcactgaagatccccccamaattttggttgactgtgacatct

SEQ ID NO: 585 - DNA, 47 bp, Homo Sapiens
  allele 24: 99-15543-55 : polymorphic base C or T
ctatatagatgcagaaatatctaytctcaagaattactacacttttc

SEQ ID NO: 586 - DNA, 47 bp, Homo Sapiens
  allele 24: 99-15545-282 : polymorphic base A or G
tgaaagagaaagcataaagtagcraaaatcctttccagattaaaaaa

SEQ ID NO: 587 - DNA, 47 bp, Homo Sapiens
  allele 24: 99-15557-50 : polymorphic base A or G
ttaaacacctatacaagctaagtracaccattaatattcctgaatca

SEQ ID NO: 588 - DNA, 47 bp, Homo Sapiens
  allele 24: 99-1557-251 : polymorphic base C or T
aatggctgcccttactgcttgagytttacagtttgtgaaattaaata

SEQ ID NO: 589 - DNA, 47 bp, Homo Sapiens
  allele 24: 99-15574-261 : polymorphic base G or T
aggtggtaatctttacacacgttkgattctcaatccaaactcctcgt

SEQ ID NO: 590 - DNA, 47 bp, Homo Sapiens
  allele 24: 99-15575-278 : polymorphic base G or T
tacaataaaacaatagtaatcaakaataatatggtatttatatgagg

SEQ ID NO: 591 - DNA, 47 bp, Homo Sapiens
  allele 24: 99-1558-26 : polymorphic base C or T
aatcaggcactgtgacaaatgcayggaatataactgagaaagacaca

SEQ ID NO: 592 - DNA, 47 bp, Homo Sapiens
  allele 24: 99-15595-41 : polymorphic base A or G
tcctagaatctatgtaagaatcargtattgtttttattctgtcaaag

SEQ ID NO: 593 - DNA, 47 bp, Homo Sapiens
  allele 24: 99-15596-64 : polymorphic base C or T
tgaaatcacaaggtatgagaatgygggaggtattggtttcccacagg

SEQ ID NO: 594 - DNA, 47 bp, Homo Sapiens; identical to SEQ ID NO: 592
  allele 24: 99-15599-252 : polymorphic base A or G

SEQ ID NO: 595 - DNA, 47 bp, Homo Sapiens
  allele 24: 99-15605-221 : polymorphic base A or G
ttatgacctaaaaaagcaggagarataaaggttattttaagcacaat

SEQ ID NO: 596 - DNA, 47 bp, Homo Sapiens
  allele 24: 99-15606-326 : polymorphic base C or T
gacctcattgtttcttgttttgtytctgacatgcaacccgccacgca

SEQ ID NO: 597 - DNA, 47 bp, Homo Sapiens
  allele 24: 99-15625-299 : polymorphic base G or C
ctgtctcgtattcctcaaagcccstcttcccttcccattctcagctg

SEQ ID NO: 598 - DNA, 47 bp, Homo Sapiens
  allele 24: 99-15627-324 : polymorphic base A or C
gattctgactcttaactacaaagmaatggctcccaaggttatagcca

SEQ ID NO: 599 - DNA, 47 bp, Homo Sapiens
  allele 24: 99-15636-159 : polymorphic base A or G
gcagtggttacatatttcagcctraggccgacttggctttcatcctc

SEQ ID NO: 600 - DNA, 47 bp, Homo Sapiens
  allele 24: 99-15638-65 : polymorphic base C or T
attattctcttgttagatatccaygatatcacagaatgccacctcgg

SEQ ID NO: 601 - DNA, 47 bp, Homo Sapiens
  allele 24: 99-15648-83 : polymorphic base A or G
aaggttttgtatttcctggccccrccaaaaggtgaatttgttggtag

SEQ ID NO: 602 - DNA, 47 bp, Homo Sapiens
  allele 24: 99-15659-332 : polymorphic base G or C
ggcaatacatttacataaaagatstctttcaataattggtgtcaggg

SEQ ID NO: 603 - DNA, 47 bp, Homo Sapiens
  allele 24: 99-1568-240 : polymorphic base A or T
atttatttctgttttggatcattwaaaactggcgttagttcttcaac

SEQ ID NO: 604 - DNA, 47 bp, Homo Sapiens
  allele 24: 99-15705-110 : polymorphic base C or T
gtttttacattagtgtgttttgayagcacacaatggtttcctcagtt

SEQ ID NO: 605 - DNA, 47 bp, Homo Sapiens
  allele 24: 99-15717-120 : polymorphic base C or T
caatgacaacaaaaaataaaattycccagaaagaatgggatgcaaga

SEQ ID NO: 606 - DNA, 47 bp, Homo Sapiens
  allele 24: 99-15718-234 : polymorphic base C or T
tgtggaaaggtctgtgaaacataytgttcactgcaaaaaataacaat

SEQ ID NO: 607 - DNA, 47 bp, Homo Sapiens
  allele 24: 99-1572-440 : polymorphic base C or T
agcccaggagtttgagaccagccygggcaacacagtggaccctgtct

SEQ ID NO: 608 - DNA, 47 bp, Homo Sapiens
  allele 24: 99-15728-334 : polymorphic base A or T
ccgaactcatgacccttaacttawcgtggtctagccaaatgagtttt

SEQ ID NO: 609 - DNA, 47 bp, Homo Sapiens
  allele 24: 99-15739-113 : polymorphic base C or T
tcataggacttataacttacatgytgtttttccatgtttttctttta

SEQ ID NO: 610 - DNA, 47 bp, Homo Sapiens
  allele 24: 99-15744-344 : polymorphic base C or T
tggactatctaaaattaaattagytcacagcctttcattcagatgca

SEQ ID NO: 611 - DNA, 47 bp, Homo Sapiens; identical to SEQ ID NO: 566
  allele 24: 99-15747-185 : polymorphic base C or T

SEQ ID NO: 612 - DNA, 47 bp, Homo Sapiens
  allele 24: 99-15748-360 : polymorphic base A or C
gaatctggggctgggaccacaacmttctgctgagtcatttacaggag

SEQ ID NO: 613 - DNA, 47 bp, Homo Sapiens
  allele 24: 99-15756-54 : polymorphic base C or T
ctaggactttcagaagcacacttyccttttgttacaacttttttttc

SEQ ID NO: 614 - DNA, 47 bp, Homo Sapiens
  allele 24: 99-15758-119 : polymorphic base C or T
gaaggttgaaaagtactgacagcyagttacttacacagggaaggaag

SEQ ID NO: 615 - DNA, 47 bp, Homo Sapiens
  allele 24: 99-15762-455 : polymorphic base A or G
aaaatatcagagggttgccacctrcagaagcttgtgggactgtgaac

SEQ ID NO: 616 - DNA, 47 bp, Homo Sapiens
  allele 24: 99-1577-105 : polymorphic base A or G
gcagttgtggcaaataattggcartatctattgttctgaaactggtt

SEQ ID NO: 617 - DNA, 47 bp, Homo Sapiens
  allele 24: 99-15774-268 : polymorphic base A or G
tttgaattgtgtgtggtgtgtgtrtgtgtgtacatgggcatacatgt

SEQ ID NO: 618 - DNA, 47 bp, Homo Sapiens
  allele 24: 99-15776-158 : polymorphic base C or T
catgaagtcaaaacttgaagggtytggccatgctaaaggctttcccg

SEQ ID NO: 619 - DNA, 47 bp, Homo Sapiens
  allele 24: 99-1578-496 : polymorphic base C or T
gtattttttgttttctggtgtcaygtgcctcccaccctgctcctagc

SEQ ID NO: 620 - DNA, 47 bp, Homo Sapiens
  allele 24: 99-15798-86 : polymorphic base C or T
caggctgcaaaaatataggctggygggtggcagtaccgtaacttacc

SEQ ID NO: 621 - DNA, 47 bp, Homo Sapiens
  allele 24: 99-15803-52 : polymorphic base A or G
tttggagaagggctggaactagcrcttagttcttctaactcctcgtg

SEQ ID NO: 622 - DNA, 47 bp, Homo Sapiens
  allele 24: 99-15805-327 : polymorphic base A or G
ccccagtcagtgtttaccgtgatrcctggtacaagcagttaccaaag

SEQ ID NO: 623 - DNA, 47 bp, Homo Sapiens
  allele 24: 99-1582-430 : polymorphic base C or T
gtgaactgtaacctaactggatgygtaaacagactataacctactct

SEQ ID NO: 624 - DNA, 47 bp, Homo Sapiens
  allele 24: 99-15826-407 : polymorphic base G or T
tgttgtatcataagtatcttaatkgtaggaataattaataactaatt

SEQ ID NO: 625 - DNA, 47 bp, Homo Sapiens
  allele 24: 99-15830-282 : polymorphic base A or G
tttgatactccagcaaattttttrtattctagcagtatgtcagcatt

SEQ ID NO: 626 - DNA, 47 bp, Homo Sapiens
  allele 24: 99-1585-373 : polymorphic base C or T
gtcagcaacgaacatgtgagcaayagaatctacgtcataatkaagtt

SEQ ID NO: 627 - DNA, 47 bp, Homo Sapiens
  allele 24: 99-1587-281 : polymorphic base A or G
ttcaacaacatggaaaatatgtgrtagcagacctggattttccttaa

SEQ ID NO: 628 - DNA, 47 bp, Homo Sapiens
  allele 24: 99-15891-215 : polymorphic base A or G
ttccttttcttttacagaaaaccraaagataaaaattcactaaaaca

SEQ ID NO: 629 - DNA, 47 bp, Homo Sapiens
  allele 24: 99-15910-116 : polymorphic base A or C
catacagaagaattcatgtggtcmtgagagcgaggacatggccgatc

SEQ ID NO: 630 - DNA, 47 bp, Homo Sapiens
  allele 24: 99-15916-270 : polymorphic base A or G
aactctggaaaactgcaaagtacrtgccttggaattactttagccaa

SEQ ID NO: 631 - DNA, 47 bp, Homo Sapiens
  allele 24: 99-15925-331 : polymorphic base C or T
agaggagggtccatgagaacaaayttcccagccctactttcatttgt

SEQ ID NO: 632 - DNA, 47 bp, Homo Sapiens
  allele 24: 99-15947-109 : polymorphic base C or T
ccagcttacgcaactgccatctgygacttggcctttgcccattgctt

SEQ ID NO: 633 - DNA, 47 bp, Homo Sapiens
  allele 24: 99-15965-67 : polymorphic base A or G
agcgtaaaaagctttttgagtttrtgcatcataatacatctttgact

SEQ ID NO: 634 - DNA, 47 bp, Homo Sapiens
  allele 24: 99-15966-87 : polymorphic base C or T
tggcagttgtccccaaagccataygttgtacttagaattgtttttaa

SEQ ID NO: 635 - DNA, 47 bp, Homo Sapiens
  allele 24: 99-15968-59 : polymorphic base A or G
agcgtggctgagcagtaggagtcrggcaggtatctcggaagacaaag

SEQ ID NO: 636 - DNA, 47 bp, Homo Sapiens
  allele 24: 99-1597-162 : polymorphic base A or G
ccctggtctctgaatgacagagtrtgcatgggggctaggaggaagga

SEQ ID NO: 637 - DNA, 47 bp, Homo Sapiens
  allele 24: 99-15970-56 : polymorphic base A or G
tctcaaaatggtgccatttgacartggcacacacttgaatttgtttg

SEQ ID NO: 638 - DNA, 47 bp, Homo Sapiens
  allele 24: 99-15973-73 : polymorphic base C or T
gggtaggctatgatttgagctgaygttttgcttccaaggacacggtc

SEQ ID NO: 639 - DNA, 47 bp, Homo Sapiens
  allele 24: 99-15981-298 : polymorphic base A or G
tgacattgtgcttccttttgtatrgcgtaatggtgataaccatgttc

SEQ ID NO: 640 - DNA, 47 bp, Homo Sapiens
  allele 24: 99-15985-354 : polymorphic base A or G
ggaacccttcagtactccttttcrgtactccactgtgagaagcatca

SEQ ID NO: 641 - DNA, 47 bp, Homo Sapiens
  allele 24: 99-15992-145 : polymorphic base A or C
tcctgccctgtccctgagtatctmcacacaagcagaaaactggagat

SEQ ID NO: 642 - DNA, 47 bp, Homo Sapiens
  allele 24: 99-15996-361 : polymorphic base G or T
gggaattacaactctttccaaagkagtttaacactggaccccagcaa

SEQ ID NO: 643 - DNA, 47 bp, Homo Sapiens
  allele 24: 99-16003-91 : polymorphic base G or C
ccctctacaggggcaagtaaacastggggtgtttgcggtgggagccc

SEQ ID NO: 644 - DNA, 47 bp, Homo Sapiens
  allele 24: 99-16005-314 : polymorphic base C or T
tccttgcaggccaaagtggaatcygtgtacttgctcatacatcctac

SEQ ID NO: 645 - DNA, 47 bp, Homo Sapiens
  allele 24: 99-1601-402 : polymorphic base A or T
cagccttgcagctattgcattccwgtccaaaccaacggcaggttctc

SEQ ID NO: 646 - DNA, 47 bp, Homo Sapiens
  allele 24: 99-1602-200 : polymorphic base G or C
aatcgagaccatcctggctaacasagtgaaaccccgtctctactaaa

SEQ ID NO: 647 - DNA, 47 bp, Homo Sapiens
  allele 24: 99-16022-325 : polymorphic base A or G
tacagaaaagagatggctaaatcrtttattccaggtttcacggctag

SEQ ID NO: 648 - DNA, 47 bp, Homo Sapiens
  allele 24: 99-16023-160 : polymorphic base G or C
atgccaagtcagttatttaacccscagataggaattcttctctagaa

SEQ ID NO: 649 - DNA, 47 bp, Homo Sapiens
  allele 24: 99-16030-317 : polymorphic base A or G
ttgtgtccgagaagcagttggccrtgctgggattgtgaccccagtgt

SEQ ID NO: 650 - DNA, 47 bp, Homo Sapiens
  allele 24: 99-1605-112 : polymorphic base A or G
tgatgaaagctaattgggcctcaragtatcaaatggtctctcccgcc

SEQ ID NO: 651 - DNA, 47 bp, Homo Sapiens
  allele 24: 99-1607-373 : polymorphic base A or G
gagtaaaggacgtgccatccccaratatgccagatggggggtattga

SEQ ID NO: 652 - DNA, 47 bp, Homo Sapiens
  allele 24: 99-1611-382 : polymorphic base A or G
ttttgtattcagttggttaatgartgtactttttcaatgctgaagca

SEQ ID NO: 653 - DNA, 47 bp, Homo Sapiens
  allele 24: 99-16121-51 : polymorphic base C or T
gggtttagctgcataatttcatayagtgcctttggagaaataagatt

SEQ ID NO: 654 - DNA, 47 bp, Homo Sapiens
  allele 24: 99-16128-88 : polymorphic base C or T
caatgtctaggagagagggaccgyatatggatcggggaaatataata

SEQ ID NO: 655 - DNA, 47 bp, Homo Sapiens
  allele 24: 99-16129-69 : polymorphic base C or T
ttgtgatttacaagcctgtgaaaycagaggcttccccatcagggctt

SEQ ID NO: 656 - DNA, 47 bp, Homo Sapiens
  allele 24: 99-16139-79 : polymorphic base A or G
aaattctgaaacccggagcttatrtaggacaattggcaatctgccca

SEQ ID NO: 657 - DNA, 47 bp, Homo Sapiens
  allele 24: 99-16140-324 : polymorphic base A or G
cttagaccatcatgcctctgatcrccttgtacctctcattggtgatg

SEQ ID NO: 658 - DNA, 47 bp, Homo Sapiens
  allele 24: 99-1615-118 : polymorphic base A or G
accagggtagactcgctctggccrtatgtaatgatgtctgtggctac

SEQ ID NO: 659 - DNA, 47 bp, Homo Sapiens
  allele 24: 99-16166-331 : polymorphic base A or G
tttacttctggtttggagtctgtrtttttgtactttctctttgcttg

SEQ ID NO: 660 - DNA, 47 bp, Homo Sapiens
  allele 24: 99-16167-130 : polymorphic base G or C
atttttgctgattatgtaaagtascaccatatgaacaactttccagt

SEQ ID NO: 661 - DNA, 47 bp, Homo Sapiens
  allele 24: 99-16188-76 : polymorphic base A or G
cattaaaattaaaaatgctctctrttaaaaaaattatgattcactac

SEQ ID NO: 662 - DNA, 47 bp, Homo Sapiens
  allele 24: 99-16192-217 : polymorphic base A or C
gaatcatcaaacttgccaacagcmaaaaaccattagtaaattctaca

SEQ ID NO: 663 - DNA, 47 bp, Homo Sapiens
  allele 24: 99-16198-203 : polymorphic base A or T
ttacctctatcaatatactgtacwtaaaaaggttttatatgtaatac

SEQ ID NO: 664 - DNA, 47 bp, Homo Sapiens
  allele 24: 99-16202-240 : polymorphic base A or G
acagttgcattctcaatagatttrggcagacagggaaaaacaagctg

SEQ ID NO: 665 - DNA, 47 bp, Homo Sapiens
  allele 24: 99-16205-255 : polymorphic base A or G
tatggagtgctaaacacgtgcccrgagctgtgctgggtgctggcacc

SEQ ID NO: 666 - DNA, 47 bp, Homo Sapiens
  allele 24: 99-16210-217 : polymorphic base A or T
atagacaaaatttctcacatttgwcatatgtaacatcaaacattttg

SEQ ID NO: 667 - DNA, 47 bp, Homo Sapiens
  allele 24: 99-1622-158 : polymorphic base G or C
aaattattcccatcccccaaatgstagttttattactgttatctatt

SEQ ID NO: 668 - DNA, 47 bp, Homo Sapiens
  allele 24: 99-16221-161 : polymorphic base G or C
tatttggtgctctcaggagatgastttgcctctgacatcacagaaaa

SEQ ID NO: 669 - DNA, 47 bp, Homo Sapiens
  allele 24: 99-16227-270 : polymorphic base A or G
atacttaattttaggagtttactrtgtctatactggaatgggaaagt

SEQ ID NO: 670 - DNA, 47 bp, Homo Sapiens
  allele 24: 99-1623-145 : polymorphic base C or T
ctagctgaggtcccatcatgtctygcctgctgttgcaatagccttca

SEQ ID NO: 671 - DNA, 47 bp, Homo Sapiens
  allele 24: 99-16247-447 : polymorphic base A or G
tttactgttattgctgttactcarcattttactggaggcattaatac

SEQ ID NO: 672 - DNA, 47 bp, Homo Sapiens
  allele 24: 99-16254-304 : polymorphic base A or G
aaatttttaaagaactggacttgrtatttaaattccttactggcagc

SEQ ID NO: 673 - DNA, 47 bp, Homo Sapiens
  allele 24: 99-16260-277 : polymorphic base A or G
ttgacatttttagtttaaagaaartgggttaaaatgactaaaatttc

SEQ ID NO: 674 - DNA, 47 bp, Homo Sapiens
  allele 24: 99-16262-232 : polymorphic base C or T
agcccctgtgcagctggacttgayccgaggataaaatccagagagac

SEQ ID NO: 675 - DNA, 47 bp, Homo Sapiens
  allele 24: 99-16265-88 : polymorphic base G or C
attttgagaatattctcctctatsttctgcatttaaatgaagggtca

SEQ ID NO: 676 - DNA, 47 bp, Homo Sapiens
  allele 24: 99-16279-409 : polymorphic base G or T
catcatagctgtagaaagtttcckatctcaaaagaccagacatgtgc

SEQ ID NO: 677 - DNA, 47 bp, Homo Sapiens
  allele 24: 99-16308-315 : polymorphic base A or G
taggaaaccttttccttctcagartctacaataggaagggattaatc

SEQ ID NO: 678 - DNA, 47 bp, Homo Sapiens
  allele 24: 99-16346-433 : polymorphic base C or T
tctcggatctcatgcctcccagcygggtgagaacccccgcaaacaga

SEQ ID NO: 679 - DNA, 47 bp, Homo Sapiens
  allele 24: 99-16366-425 : polymorphic base A or T
acaaatagtgaggcacaaactgcwgcgattttaagatgcaacatcat

SEQ ID NO: 680 - DNA, 47 bp, Homo Sapiens
  allele 24: 99-1637-345 : polymorphic base C or T
ggtgtcataccctagtattaccaycctcatccgtgtatctcaacaga

SEQ ID NO: 681 - DNA, 47 bp, Homo Sapiens
  allele 24: 99-16375-469 : polymorphic base C or T
tcccaacttacttcggtagctttyaattgtgttgttgagctgtcttg

SEQ ID NO: 682 - DNA, 47 bp, Homo Sapiens
  allele 24: 99-1638-571 : polymorphic base C or T
atagtaatggaaacaaaactctaygaagattgcttaataaagatact

SEQ ID NO: 683 - DNA, 47 bp, Homo Sapiens
  allele 24: 99-16386-484 : polymorphic base G or C
tgcttagaaaagaggttctctttscattccttatttcctgtagccag

SEQ ID NO: 684 - DNA, 47 bp, Homo Sapiens
  allele 24: 99-16396-174 : polymorphic base C or T
catgtttgatcaacattcctagtytgcaaatcaggactgagtctctg

SEQ ID NO: 685 - DNA, 47 bp, Homo Sapiens
  allele 24: 99-16399-135 : polymorphic base A or C
tccctgagtcttcattttctcatmtgtatgagtggaaataatagtga

SEQ ID NO: 686 - DNA, 47 bp, Homo Sapiens
  allele 24: 99-16403-273 : polymorphic base A or G
  misc_feature 39: n=a, g, c or t
tctgaaataaacacaaacagctcrggctaaaaaaaaggnacactcac

SEQ ID NO: 687 - DNA, 47 bp, Homo Sapiens
  allele 24: 99-16407-260 : polymorphic base A or C
tgtatactggcccaccccagctamgaggtagatgagtcggggcaaat

SEQ ID NO: 688 - DNA, 47 bp, Homo Sapiens
  allele 24: 99-16409-58 : polymorphic base A or T
agaccctctccccattcctttccwccccaaaccccccacccccacca

SEQ ID NO: 689 - DNA, 47 bp, Homo Sapiens
  allele 24: 99-16414-297 : polymorphic base A or C
ttatgtagagaagccaggagaacmgagaaaaaagtgtattttataga

SEQ ID NO: 690 - DNA, 47 bp, Homo Sapiens
  allele 24: 99-16445-444 : polymorphic base C or T
aaattaacttgaattcctcaaggycttggagtataaggagaatggat

SEQ ID NO: 691 - DNA, 47 bp, Homo Sapiens
  allele 24: 99-16466-419 : polymorphic base A or C
tttctagatggcctttctctgtcmtagtctcctgtttgtccaaagac

SEQ ID NO: 692 - DNA, 47 bp, Homo Sapiens
  allele 24: 99-16474-299 : polymorphic base G or T
ttggggggcaaataatgttttgckgctttttttagtatttttacatc

SEQ ID NO: 693 - DNA, 47 bp, Homo Sapiens
  allele 24: 99-16500-380 : polymorphic base A or T
tagaatatcagcaaagcacagaawgagccagcttggcatctgtgtgt

SEQ ID NO: 694 - DNA, 47 bp, Homo Sapiens
  allele 24: 99-16505-368 : polymorphic base G or C
tccatctcagacctggagagtctsgtcccttcttaggccccagcgat

SEQ ID NO: 695 - DNA, 47 bp, Homo Sapiens
  allele 24: 99-16526-375 : polymorphic base A or C
tcactgtgtgtctcccagcctgamgggattatgtccttgaatgatga

SEQ ID NO: 696 - DNA, 47 bp, Homo Sapiens
  allele 24: 99-16528-194 : polymorphic base C or T
ataaatggcaacatgatcccaggyctaaaatccaccctggcattgaa

SEQ ID NO: 697 - DNA, 47 bp, Homo Sapiens
  allele 24: 99-16531-251 : polymorphic base A or G
ggaatgcaagtaacaacatgagtractagaacaacgaaatatcataa

SEQ ID NO: 698 - DNA, 47 bp, Homo Sapiens
  allele 24: 99-16535-344 : polymorphic base C or T
tttatgcaaggggctttgactttyacagaagagacttagctcgtcaa

SEQ ID NO: 699 - DNA, 47 bp, Homo Sapiens
  allele 24: 99-16559-90 : polymorphic base A or G
attactagcagagtgaattttgtrgcaaaatgtttaattttatttaa

SEQ ID NO: 700 - DNA, 47 bp, Homo Sapiens; identical to SEQ ID NO: 699
  allele 24: 99-16562-182 : polymorphic base A or G

SEQ ID NO: 701 - DNA, 47 bp, Homo Sapiens
  allele 24: 99-16563-263 : polymorphic base G or C
ggcatgattatagatattagatasaaagttgattgacttcatttttg

SEQ ID NO: 702 - DNA, 47 bp, Homo Sapiens
  allele 24: 99-16564-118 : polymorphic base A or G
aattgttaattttataaacaccartgattggggattgaatttgaatg

SEQ ID NO: 703 - DNA, 47 bp, Homo Sapiens
  allele 24: 99-16568-283 : polymorphic base G or T
tctttgaagtcggatcaagatttkcgtacatatcctaccagtctaag

SEQ ID NO: 704 - DNA, 47 bp, Homo Sapiens
  allele 24: 99-16569-65 : polymorphic base A or G
agcatttctcgagtgcttgtcccrtgccaggcagcggctacagccat

SEQ ID NO: 705 - DNA, 47 bp, Homo Sapiens
  allele 24: 99-1658-474 : polymorphic base C or T
gaggacagagatagatccctaggytgcctgaacgaagagatctgcaa

SEQ ID NO: 706 - DNA, 47 bp, Homo Sapiens
  allele 24: 99-16611-318 : polymorphic base A or C
gagtcgcgtctggtagagcatctmgtattttctccctacctgccctt

SEQ ID NO: 707 - DNA, 47 bp, Homo Sapiens
  allele 24: 99-1664-289 : polymorphic base C or T
aatgtagaccaagggtcggcaaayattttctgtataggggcagatag

SEQ ID NO: 708 - DNA, 47 bp, Homo Sapiens
  allele 24: 99-16655-135 : polymorphic base C or T
atttaaaatggatacatttttatygttatatatgtatgtatgtgaat

SEQ ID NO: 709 - DNA, 47 bp, Homo Sapiens
  allele 24: 99-16657-361 : polymorphic base A or G
gccatttcagttagataactcccrcttgatctttaggcctctcaatt

SEQ ID NO: 710 - DNA, 47 bp, Homo Sapiens
  allele 24: 99-16677-346 : polymorphic base C or T
gatgtgtggatttcagtgtaatgyggcctatatcaattttccagggt

SEQ ID NO: 711 - DNA, 47 bp, Homo Sapiens
  allele 24: 99-16683-465 : polymorphic base A or C
gagcatttcaggtttgctctttamatatagacacccctcaccatgag

SEQ ID NO: 712 - DNA, 47 bp, Homo Sapiens
  allele 24: 99-16692-343 : polymorphic base G or T
aaaccacaaacagaaaacaggcakgaagcatggatcagcagcaacac

SEQ ID NO: 713 - DNA, 47 bp, Homo Sapiens
  allele 24: 99-16697-149 : polymorphic base A or C
taatgttaataaataaaatactgmattttaaagctgttaagaaattg

SEQ ID NO: 714 - DNA, 47 bp, Homo Sapiens
  allele 24: 99-16708-273 : polymorphic base A or G
tagtcaggtatataataatgaagrgtgcctttgtatgtcagcgttga

SEQ ID NO: 715 - DNA, 47 bp, Homo Sapiens
  allele 24: 99-16740-391 : polymorphic base G or T
aggagggctctgagtgggctgggkcagctcggaaaatttcctgggcg

SEQ ID NO: 716 - DNA, 47 bp, Homo Sapiens
  allele 24: 99-16768-54 : polymorphic base A or T
tcataagaattcctttatcaattwtactccatggcccccagttttgc

SEQ ID NO: 717 - DNA, 47 bp, Homo Sapiens
  allele 24: 99-16801-374 : polymorphic base C or T
aagggctgagttatagtctaagayggagcttaaatctcttttaatct

SEQ ID NO: 718 - DNA, 47 bp, Homo Sapiens
  allele 24: 99-16827-356 : polymorphic base A or G
catggagtccacatttctagtagrggcagacagaaagccaacacaac

SEQ ID NO: 719 - DNA, 47 bp, Homo Sapiens
  allele 24: 99-16838-212 : polymorphic base C or T
cctcagacagcatctgccctgcaygagccctgtgccaggaggtgaac

SEQ ID NO: 720 - DNA, 47 bp, Homo Sapiens
  allele 24: 99-16841-120 : polymorphic base A or T
tttttggttatggtttttgaaaawattccctctgcctccttccctat

SEQ ID NO: 721 - DNA, 47 bp, Homo Sapiens
  allele 24: 99-16842-362 : polymorphic base A or G
gtggtgtggtaggtgaaatttgaraggagtgctgggatgtctccaga

SEQ ID NO: 722 - DNA, 47 bp, Homo Sapiens
  allele 24: 99-16845-234 : polymorphic base A or G
acttgtgtgtgtgctgatttttgrtatgtgctcaactttgacacaca

SEQ ID NO: 723 - DNA, 47 bp, Homo Sapiens
  allele 24: 99-16847-405 : polymorphic base A or G
attttccccatatttaacgatttrcagaggaaggtgccactttttaa

SEQ ID NO: 724 - DNA, 47 bp, Homo Sapiens
  allele 24: 99-16855-84 : polymorphic base G or C
tgaattagagaacacagagcaaascatagcatgtcagccctgcatct

SEQ ID NO: 725 - DNA, 47 bp, Homo Sapiens
  allele 24: 99-16867-193 : polymorphic base C or T
ccgaggggcctatgtgacaccccygcatgtggatgaaaatcacccag

SEQ ID NO: 726 - DNA, 47 bp, Homo Sapiens
  allele 24: 99-16873-407 : polymorphic base G or C
atacatgtaaagcgcttagaagasggtcttgcacacagcagatgatc

SEQ ID NO: 727 - DNA, 47 bp, Homo Sapiens
  allele 24: 99-16886-198 : polymorphic base G or T
cttgccttccatttcatatagttkaattgcacgtatttgcattcata

SEQ ID NO: 728 - DNA, 47 bp, Homo Sapiens
  allele 24: 99-16891-264 : polymorphic base C or T
cttcaggattaacttgatataggygctcaagtaatgtcaggatgcac

SEQ ID NO: 729 - DNA, 47 bp, Homo Sapiens
  allele 24: 99-16894-85 : polymorphic base C or T
gcctgagcagtcctaaactccttyagtaggggtaattataaatcatc

SEQ ID NO: 730 - DNA, 47 bp, Homo Sapiens
  allele 24: 99-16895-56 : polymorphic base A or C
tcagaaaccagtttccagacacamtttataaagcctagtaaatcagg

SEQ ID NO: 731 - DNA, 47 bp, Homo Sapiens
  allele 24: 99-16903-53 : polymorphic base A or G
ttcctctgttaaccaggaaacctrtctgtcccgcacctcctaactcc

SEQ ID NO: 732 - DNA, 47 bp, Homo Sapiens
  allele 24: 99-16905-281 : polymorphic base C or T
atttctgcccaggtgttccatttytgggaactttgccaaagtaaata

SEQ ID NO: 733 - DNA, 47 bp, Homo Sapiens
  allele 24: 99-16906-114 : polymorphic base A or G
cccacaaacactgcctatcatcartcaaattgctataactatgtacc

SEQ ID NO: 734 - DNA, 47 bp, Homo Sapiens
  allele 24: 99-16913-94 : polymorphic base A or G
tgccactggactccctcgcctctrtgtaagccccttataaaaccaca

SEQ ID NO: 735 - DNA, 47 bp, Homo Sapiens
  allele 24: 99-16914-412 : polymorphic base A or G
aagagggtagaaagtccagggagrcctgcagtgggtactctcaggga

SEQ ID NO: 736 - DNA, 47 bp, Homo Sapiens
  allele 24: 99-16929-479 : polymorphic base A or C
attttaatagacataattaaaaamattaatcaaagttgactctagtc

SEQ ID NO: 737 - DNA, 47 bp, Homo Sapiens
  allele 24: 99-16930-306 : polymorphic base C or T
taataaagtggaagagagatgatytgtggtaagaagttcctcaaatt

SEQ ID NO: 738 - DNA, 47 bp, Homo Sapiens
  allele 24: 99-16933-33 : polymorphic base A or G
tttctttccagggaacttctcatrtgaatctgtgctttttgaaatcc

SEQ ID NO: 739 - DNA, 47 bp, Homo Sapiens
  allele 24: 99-16946-157 : polymorphic base A or C
taacaggctccagtgggacagatmaatgccaagcagcttggtatgag

SEQ ID NO: 740 - DNA, 47 bp, Homo Sapiens
  allele 24: 99-16948-390 : polymorphic base A or T
catacatatatacacgtgattcawacatgtgtatgaatatacaaata

SEQ ID NO: 741 - DNA, 47 bp, Homo Sapiens
  allele 24: 99-16952-248 : polymorphic base A or C
tttcactgttgagaacttcagatmttttcattatattttactgagct

SEQ ID NO: 742 - DNA, 47 bp, Homo Sapiens
  allele 24: 99-16975-253 : polymorphic base G or C
gaactgaggtaaactatgagttgsggggagggaattttggagacaat

SEQ ID NO: 743 - DNA, 47 bp, Homo Sapiens
  allele 24: 99-16979-274 : polymorphic base A or G
aaccagaacttgcttgtaatgccraaagaagtcagggacacgctaag

SEQ ID NO: 744 - DNA, 47 bp, Homo Sapiens
  allele 24: 99-16990-155 : polymorphic base C or T
tcattttaaattactggttagtaytgagaagatgaatatgtcaaatg

SEQ ID NO: 745 - DNA, 47 bp, Homo Sapiens
  allele 24: 99-16994-63 : polymorphic base A or G
tccaacccctcactctggaagacrttgagaagcctaacttgagtcta

SEQ ID NO: 746 - DNA, 47 bp, Homo Sapiens
  allele 24: 99-17001-311 : polymorphic base C or T
ggtgagtccctcaacgacctggayggcccctgcctccctctgtggcc

SEQ ID NO: 747 - DNA, 47 bp, Homo Sapiens
  allele 24: 99-17008-420 : polymorphic base C or T
gtgtaaatattataaaataaccaygagcagcaagatagaaaaaatct

SEQ ID NO: 748 - DNA, 47 bp, Homo Sapiens
  allele 24: 99-1701-39 : polymorphic base A or G
  misc_feature 39,43..44,46: n=a, g, c or t
tggaaaagaaatcctgcacccctrctcacagtcactccnaganntnc

SEQ ID NO: 749 - DNA, 47 bp, Homo Sapiens
  allele 24: 99-17013-217 : polymorphic base G or T
tggcgcccagtgagccttgcacakggaacagggagtgaaatcaccca

SEQ ID NO: 750 - DNA, 47 bp, Homo Sapiens
  allele 24: 99-17016-258 : polymorphic base A or G
aatactgtactctgccacagcacrctggattattttgctgcgattgt

SEQ ID NO: 751 - DNA, 47 bp, Homo Sapiens
  allele 24: 99-17028-56 : polymorphic base A or G
gctttggtcaggccagtggtcccrgtctcattggtctgctctcatgc

SEQ ID NO: 752 - DNA, 47 bp, Homo Sapiens
  allele 24: 99-17045-267 : polymorphic base A or G
acatggaagataaaaatcgctggratgtcaaccttttaccctgttat

SEQ ID NO: 753 - DNA, 47 bp, Homo Sapiens
  allele 24: 99-17048-207 : polymorphic base A or C
aactacatagataagaaggagttmtgcagatggcttttcagataagt

SEQ ID NO: 754 - DNA, 47 bp, Homo Sapiens
  allele 24: 99-17052-71 : polymorphic base A or G
gctaatacagtgaagccttgagcrctgatgcccctctcaccctccaa

SEQ ID NO: 755 - DNA, 47 bp, Homo Sapiens
  allele 24: 99-17062-102 : polymorphic base A or G
tttcttcccattttctaaattctraagagaatttgaatatattctag

SEQ ID NO: 756 - DNA, 47 bp, Homo Sapiens
  allele 24: 99-17065-230 : polymorphic base A or G
gactactgcagttgtctgtaaacragatgaaaagggttagctttgaa

SEQ ID NO: 757 - DNA, 47 bp, Homo Sapiens
  allele 24: 99-17084-191 : polymorphic base A or G
gcatcgtatagaggatatgcagcrttggttgagaacagaaaggagtc

SEQ ID NO: 758 - DNA, 47 bp, Homo Sapiens
  allele 24: 99-1709-597 : polymorphic base G or C
gtggaactcagctctaaaatctgsacagtctgcaaccatcataaatg

SEQ ID NO: 759 - DNA, 47 bp, Homo Sapiens
  allele 24: 99-17094-132 : polymorphic base C or T
tattcccattattgaagctttcaygtttggattctgcrtcattaaag

SEQ ID NO: 760 - DNA, 47 bp, Homo Sapiens
  allele 24: 99-17095-424 : polymorphic base A or G
acaggaggaaattaaaccaccagractattaaacttcaagttctgat

SEQ ID NO: 761 - DNA, 47 bp, Homo Sapiens
  allele 24: 99-1710-249 : polymorphic base G or C
gaatatatttatttctagtttatsaatgtctgatttctgaagcatag

SEQ ID NO: 762 - DNA, 47 bp, Homo Sapiens
  allele 24: 99-17103-142 : polymorphic base C or T
acagacccatcaccactccaggcycagaggggaatgcgcagtcagga

SEQ ID NO: 763 - DNA, 47 bp, Homo Sapiens
  allele 24: 99-17105-147 : polymorphic base A or G
agggcatgaggagaaaccagacarctccagctaagtggacccatgca

SEQ ID NO: 764 - DNA, 47 bp, Homo Sapiens
  allele 24: 99-17112-191 : polymorphic base C or T
tgacaagtattctgtgcaagacayagactaaagctctcataagaatt

SEQ ID NO: 765 - DNA, 47 bp, Homo Sapiens
  allele 24: 99-17122-255 : polymorphic base G or C
ttccatagccccctcccagccagsagaggcctgtttcctcttctacc

SEQ ID NO: 766 - DNA, 47 bp, Homo Sapiens
  allele 24: 99-17123-320 : polymorphic base C or T
tctgtaggttttatttcaaggacyagctcaaacactacttcctttta

SEQ ID NO: 767 - DNA, 47 bp, Homo Sapiens
  allele 24: 99-17133-327 : polymorphic base A or T
cactctccaggctttggttcgtcwctgtaaaatggggagatgaatac

SEQ ID NO: 768 - DNA, 47 bp, Homo Sapiens
  allele 24: 99-17134-82 : polymorphic base C or T
cccaggtataaaacattgcattaygaagctaagaagtcatgtcaagc

SEQ ID NO: 769 - DNA, 47 bp, Homo Sapiens
  allele 24: 99-17136-384 : polymorphic base A or G
taattgatttcctttgaattcgtrtgtaattaggctattcatttaaa

SEQ ID NO: 770 - DNA, 47 bp, Homo Sapiens
  allele 24: 99-17154-256 : polymorphic base A or G
ggctggatcataaaaagcaacacrgcttcctcctggctctctttctg

SEQ ID NO: 771 - DNA, 47 bp, Homo Sapiens
  allele 24: 99-17157-33 : polymorphic base A or G
caagagctgggggccgcagtgccraagaagtgatagagctgatagag

SEQ ID NO: 772 - DNA, 47 bp, Homo Sapiens
  allele 24: 99-17159-280 : polymorphic base A or G
ctgaggcagcagcagacatgtccrtttctggggaagttactcaaaca

SEQ ID NO: 773 - DNA, 47 bp, Homo Sapiens
  allele 24: 99-17164-252 : polymorphic base G or C
aatggtaatctggcccctctgacsactacagctcccaagtggcaagc

SEQ ID NO: 774 - DNA, 47 bp, Homo Sapiens
  allele 24: 99-17165-359 : polymorphic base A or G
acagtggtgccctgaggactctcrtacccatgtaattctgcctagtg

SEQ ID NO: 775 - DNA, 47 bp, Homo Sapiens
  allele 24: 99-17169-485 : polymorphic base A or T
aacaggagcaaccctcaggcttcwaagaccaatggacatgtaggtca

SEQ ID NO: 776 - DNA, 47 bp, Homo Sapiens
  allele 24: 99-17176-315 : polymorphic base A or G
tctctgtagcatctgactctttcrttctttatatagatcatgttgaa

SEQ ID NO: 777 - DNA, 47 bp, Homo Sapiens
  allele 24: 99-17180-309 : polymorphic base A or G
aatactgacatcttttgatatctracaaccaataaggctataccagt

SEQ ID NO: 778 - DNA, 47 bp, Homo Sapiens
  allele 24: 99-17204-105 : polymorphic base A or G
gggttaggtggcagtgattggcartctccacctggagtctcagctcc

SEQ ID NO: 779 - DNA, 47 bp, Homo Sapiens
  allele 24: 99-17205-68 : polymorphic base C or T
gggtaaagagaaattgctatccayatgacagaaaataactcccactt

SEQ ID NO: 780 - DNA, 47 bp, Homo Sapiens
  allele 24: 99-17213-128 : polymorphic base C or T
gttatttctattctagtgtgccaytgcatgtctttagtttggaagac

SEQ ID NO: 781 - DNA, 47 bp, Homo Sapiens
  allele 24: 99-1723-101 : polymorphic base A or G
cttcgttaactatatacttacacrcttgcttatgttattataaatga

SEQ ID NO: 782 - DNA, 47 bp, Homo Sapiens
  allele 24: 99-17253-394 : polymorphic base G or T
acaggtctgaatttcagagtcctkcctcatggcttgacccgggcacc

SEQ ID NO: 783 - DNA, 47 bp, Homo Sapiens
  allele 24: 99-17262-65 : polymorphic base G or T
tttaattgtcctgggcattatttktcttactgaggagctagctgcca

SEQ ID NO: 784 - DNA, 47 bp, Homo Sapiens
  allele 24: 99-17274-353 : polymorphic base A or G
ccaaacccaaaaacaattttagaraactttttcctcaagtctacttt

SEQ ID NO: 785 - DNA, 47 bp, Homo Sapiens
  allele 24: 99-17282-138 : polymorphic base A or T
tcctgaggttatgaaatccaagawtctccccagtgcgggggtctgtg

SEQ ID NO: 786 - DNA, 47 bp, Homo Sapiens
  allele 24: 99-17306-27 : polymorphic base C or T
ccaactatgcccaactttcccccyaagtgttaacagttaatttaatg

SEQ ID NO: 787 - DNA, 47 bp, Homo Sapiens
  allele 24: 99-17315-86 : polymorphic base A or T
gtggcatacactgggtgcctgctwatgtgattttctgtcctcttcct

SEQ ID NO: 788 - DNA, 47 bp, Homo Sapiens
  allele 24: 99-17343-305 : polymorphic base A or G
cagttttttgcttctctcttactrtattcctgtgtttttaagtggtt

SEQ ID NO: 789 - DNA, 47 bp, Homo Sapiens
  allele 24: 99-17347-160 : polymorphic base C or T
tgctaaacaaggcaaaaatatatygcccaaggcatcaagtctcaacc

SEQ ID NO: 790 - DNA, 47 bp, Homo Sapiens
  allele 24: 99-17351-259 : polymorphic base G or T
ctctagaaacaaacaaaagattakgctgaaatattcatgaaaggttg

SEQ ID NO: 791 - DNA, 47 bp, Homo Sapiens
  allele 24: 99-17352-284 : polymorphic base C or T
agaatatttttatttctcttaggytattatgcaaaatgtcatggttt

SEQ ID NO: 792 - DNA, 47 bp, Homo Sapiens
  allele 24: 99-17357-244 : polymorphic base C or T
ccctggtaaaccaccttcctcttytgtgtttttatgaatttggtcgg

SEQ ID NO: 793 - DNA, 47 bp, Homo Sapiens
  allele 24: 99-17363-245 : polymorphic base A or G
attccatgtgagtttcacaacatrtacttcccctcaccaagtctaac

SEQ ID NO: 794 - DNA, 47 bp, Homo Sapiens
  allele 24: 99-17365-188 : polymorphic base A or G
ccacaccccatggcagggttgctrtgcaatggctaaatgaaccttgt

SEQ ID NO: 795 - DNA, 47 bp, Homo Sapiens
  allele 24: 99-17375-363 : polymorphic base G or C
ttctcttcttaaacctgggtagtsagtacagagctattcattttatt

SEQ ID NO: 796 - DNA, 47 bp, Homo Sapiens
  allele 24: 99-1738-72 : polymorphic base A or G
taggaagtcttctgaaactcctgrcgacctgcatctgagccacaagc

SEQ ID NO: 797 - DNA, 47 bp, Homo Sapiens
  allele 24: 99-17389-164 : polymorphic base G or T
tagaatttgcattggtgtaatggktcacagcatgggaatttggaaca

SEQ ID NO: 798 - DNA, 47 bp, Homo Sapiens
  allele 24: 99-1739-135 : polymorphic base A or C
gtcctgatacaaaaagtgtgttamaatattttaggtaggattatctg

SEQ ID NO: 799 - DNA, 47 bp, Homo Sapiens
  allele 24: 99-17409-293 : polymorphic base C or T
tttctttcaaaaaacaaagtcagyaagcctcaataaaatccagaata

SEQ ID NO: 800 - DNA, 47 bp, Homo Sapiens
  allele 24: 99-17412-296 : polymorphic base C or T
ggaaaagtcaatggcaattagcayaagtagtcatttatatctcagtc

SEQ ID NO: 801 - DNA, 47 bp, Homo Sapiens
  allele 24: 99-17416-310 : polymorphic base A or G
gccccaaagcctggcagtgagcartacacccagagaggtgcggggtg

SEQ ID NO: 802 - DNA, 47 bp, Homo Sapiens
  allele 24: 99-17418-41 : polymorphic base A or T
cccaactgcacaccattagcaccwctttattctaatcctagctctgt

SEQ ID NO: 803 - DNA, 47 bp, Homo Sapiens
  allele 24: 99-17420-380 : polymorphic base A or G
tagatcaactaggcagatagttarggcaagggtccttggtagaattc

SEQ ID NO: 804 - DNA, 47 bp, Homo Sapiens
  allele 24: 99-17428-129 : polymorphic base A or G
atcatgccattaccacattcatcraattcatagaagttactttgtcc

SEQ ID NO: 805 - DNA, 47 bp, Homo Sapiens
  allele 24: 99-17450-352 : polymorphic base A or G
attagtattttaatacaagaataraccaaagtatctacacatttttg

SEQ ID NO: 806 - DNA, 47 bp, Homo Sapiens
  allele 24: 99-17464-376 : polymorphic base C or T
ttgatcaatcctagaaattattcytggaaacatccaagtgactttct

SEQ ID NO: 807 - DNA, 47 bp, Homo Sapiens
  allele 24: 99-17476-141 : polymorphic base A or C
gacaagactggaattgggccttgmgagctctgcctggcaaccttggc

SEQ ID NO: 808 - DNA, 47 bp, Homo Sapiens
  allele 24: 99-17481-171 : polymorphic base C or T
tggttggccctgcactacttcctycttctccctccgcatagctatta

SEQ ID NO: 809 - DNA, 47 bp, Homo Sapiens
  allele 24: 99-17483-282 : polymorphic base G or T
aattttaaactgtttagatttttkttcatattatgtctccttctaat

SEQ ID NO: 810 - DNA, 47 bp, Homo Sapiens
  allele 24: 99-17490-199 : polymorphic base A or G
ttactgctcccttagtttttcatrttgagcctgtggtcaaataccac

SEQ ID NO: 811 - DNA, 47 bp, Homo Sapiens
  allele 24: 99-17491-362 : polymorphic base C or T
taatctgtcttgtccttcaagaayagatttaattatattttttggtt

SEQ ID NO: 812 - DNA, 47 bp, Homo Sapiens
  allele 24: 99-17495-100 : polymorphic base A or C
aattactaaccattcatgaccttmatcaaataacggtaaggctgccg

SEQ ID NO: 813 - DNA, 47 bp, Homo Sapiens
  allele 24: 99-17496-301 : polymorphic base A or C
ctctttataatacccattctattmattactaatccagttctgcaaga

SEQ ID NO: 814 - DNA, 47 bp, Homo Sapiens
  allele 24: 99-17498-312 : polymorphic base C or T
atgttactcgtactcaaactttgyatcttattttcctttgtaaaagg

SEQ ID NO: 815 - DNA, 47 bp, Homo Sapiens
  allele 24: 99-17499-62 : polymorphic base A or G
acacctggaaacagccagggaccrttattgcctggagacaaaggaga

SEQ ID NO: 816 - DNA, 47 bp, Homo Sapiens
  allele 24: 99-17520-31 : polymorphic base C or T
ctccactaccaccaccctctcacytgatgtctcagccatcctgaact

SEQ ID NO: 817 - DNA, 47 bp, Homo Sapiens
  allele 24: 99-17522-423 : polymorphic base A or G
taaatttagcagcagattgaatcrcactcaccaagatgtttgcctcc

SEQ ID NO: 818 - DNA, 47 bp, Homo Sapiens
  allele 24: 99-17523-116 : polymorphic base A or C
acactcattgctagcagagcacamaaatgaacctcaatttccattcg

SEQ ID NO: 819 - DNA, 47 bp, Homo Sapiens
  allele 24: 99-17529-210 : polymorphic base A or G
tcccatgcctttcccttctcgagraagctcctcagctgactcttcct

SEQ ID NO: 820 - DNA, 47 bp, Homo Sapiens
  allele 24: 99-17557-358 : polymorphic base C or T
gctaccagtggtctttgttgtccyaagcagaaacattgggcttgtga

SEQ ID NO: 821 - DNA, 47 bp, Homo Sapiens
  allele 24: 99-17563-102 : polymorphic base G or C
cgaagatctctggcatgatcactstcaagatatgactacgtggaaac

SEQ ID NO: 822 - DNA, 47 bp, Homo Sapiens
  allele 24: 99-17588-501 : polymorphic base A or G
accgtcagaccaatattgatggcrttactcctcttggaatccagaac

SEQ ID NO: 823 - DNA, 47 bp, Homo Sapiens
  allele 24: 99-17610-44 : polymorphic base A or G
aggcaagaaagacgtctccacacratgacaggcatctttgccaaccc

SEQ ID NO: 824 - DNA, 47 bp, Homo Sapiens
  allele 24: 99-17629-89 : polymorphic base G or T
gtttgaaatatcctctactggggkttctcctggggctagggaagttg

SEQ ID NO: 825 - DNA, 47 bp, Homo Sapiens
  allele 24: 99-1764-65 : polymorphic base G or C
aaacacattctcattctcatggtstatgtaacatgttagaatgatta

SEQ ID NO: 826 - DNA, 47 bp, Homo Sapiens
  allele 24: 99-17647-79 : polymorphic base A or G
gggattccaatatctatttcctcrgttttctttgaagtgtttcttgg

SEQ ID NO: 827 - DNA, 47 bp, Homo Sapiens
  allele 24: 99-1765-171 : polymorphic base C or T
ttgtgtttgcagtatttaaaaacygcaaaaagtagaggatactcaga

SEQ ID NO: 828 - DNA, 47 bp, Homo Sapiens
  allele 24: 99-17656-239 : polymorphic base A or G
ttggactaggttatttgcatattrattctttatgattcactcatgac

SEQ ID NO: 829 - DNA, 47 bp, Homo Sapiens
  allele 24: 99-17658-167 : polymorphic base A or G
catggattttttttttctatctcrtcacaggatcagctcaaatcaaa

SEQ ID NO: 830 - DNA, 47 bp, Homo Sapiens
  allele 24: 99-17662-126 : polymorphic base C or T
atggctcaactgtctaatttaagyccatacattaactaatagtgtca

SEQ ID NO: 831 - DNA, 47 bp, Homo Sapiens
  allele 24: 99-17663-29 : polymorphic base A or G
ctgggttagactgatcgtgatgcrttgccaagaactgaggatgttgc

SEQ ID NO: 832 - DNA, 47 bp, Homo Sapiens
  allele 24: 99-17677-251 : polymorphic base A or G
atgagcttgaagtggctcaacccrggagcttcagacctaaatttaag

SEQ ID NO: 833 - DNA, 47 bp, Homo Sapiens
  allele 24: 99-17680-451 : polymorphic base C or T
aagccaggagccccatctggtagygagacctactgtgactgcgctgt

SEQ ID NO: 834 - DNA, 47 bp, Homo Sapiens
  allele 24: 99-17683-286 : polymorphic base A or G
cagcaggaagtgggtaaagagtgracagaggagttgaggtgaaacag

SEQ ID NO: 835 - DNA, 47 bp, Homo Sapiens
  allele 24: 99-17687-373 : polymorphic base C or T
ttccatctccatcagcaaatgaaygaataagtaatgtatacaggtcc

SEQ ID NO: 836 - DNA, 47 bp, Homo Sapiens
  allele 24: 99-17700-191 : polymorphic base G or C
taaattattgtaatgagctcctgsttaatcttcctaaactctcttaa

SEQ ID NO: 837 - DNA, 47 bp, Homo Sapiens
  allele 24: 99-17702-57 : polymorphic base G or T
aaccaccttggatgacagaaaagkaggtgtccttcccaatgtgataa

SEQ ID NO: 838 - DNA, 47 bp, Homo Sapiens
  allele 24: 99-17718-259 : polymorphic base C or T
atatgaaagtggagtcagtgggaygaggacaggagaatgtgtatgcc

SEQ ID NO: 839 - DNA, 47 bp, Homo Sapiens
  allele 24: 99-17720-224 : polymorphic base G or C
tgtccttttctttgtttatacatsaaatatttcctgagctgccctga

SEQ ID NO: 840 - DNA, 47 bp, Homo Sapiens
  allele 24: 99-17728-310 : polymorphic base A or C
agtctcaaatttgcttccttaagmcctttataaccaatgtgtcccaa

SEQ ID NO: 841 - DNA, 47 bp, Homo Sapiens
  allele 24: 99-1773-343 : polymorphic base C or T
atattttttcaagtagaccaaaaytttcttacactgaagaataatta

SEQ ID NO: 842 - DNA, 47 bp, Homo Sapiens
  allele 24: 99-17740-227 : polymorphic base G or C
tactgtcaactttagtttgcaaasgtttatggaattttgggggtttt

SEQ ID NO: 843 - DNA, 47 bp, Homo Sapiens
  allele 24: 99-1775-187 : polymorphic base A or G
tttggtcaggattggccaggtttrctgcagttatgttgaccccagaa

SEQ ID NO: 844 - DNA, 47 bp, Homo Sapiens
  allele 24: 99-17758-292 : polymorphic base A or G
aaggaatacaacctattctacttraatgcccctccagttctacatcc

SEQ ID NO: 845 - DNA, 47 bp, Homo Sapiens
  allele 24: 99-17762-327 : polymorphic base A or G
gagcgggggagcgagaggacagaraattgggcagtggtatttagatc

SEQ ID NO: 846 - DNA, 47 bp, Homo Sapiens
  allele 24: 99-17773-392 : polymorphic base C or T
gtagaagctaacttgagcatcccyccaaggtctagaaagccatggtt

SEQ ID NO: 847 - DNA, 47 bp, Homo Sapiens
  allele 24: 99-17774-276 : polymorphic base C or T
tgccaaaagaggactgacagatayataagttttaagcttagggatga

SEQ ID NO: 848 - DNA, 47 bp, Homo Sapiens
  allele 24: 99-17775-286 : polymorphic base C or T
tgactcagacaagtccagcttggyaagtagataacgtttattaagac

SEQ ID NO: 849 - DNA, 47 bp, Homo Sapiens
  allele 24: 99-17776-114 : polymorphic base A or T
gcagttgacttccctaacttcagwgacctacactcaagccagcagga

SEQ ID NO: 850 - DNA, 47 bp, Homo Sapiens
  allele 24: 99-17779-117 : polymorphic base A or C
aactactacttgagatcatcattmcagcagttactactgttactact

SEQ ID NO: 851 - DNA, 47 bp, Homo Sapiens
  allele 24: 99-17792-144 : polymorphic base C or T
gttgacctgacagtctgactctcygaaaataagagagcatactgggg

SEQ ID NO: 852 - DNA, 47 bp, Homo Sapiens
  allele 24: 99-17798-345 : polymorphic base C or T
aaccgtgccagggatgttgatcgytaaccctcagtccaaccaatggt

SEQ ID NO: 853 - DNA, 47 bp, Homo Sapiens
  allele 24: 99-17802-338 : polymorphic base A or G
ggactgggtgattaatcccaggtrgccattcaccaaactatccttcc

SEQ ID NO: 854 - DNA, 47 bp, Homo Sapiens
  allele 24: 99-17808-398 : polymorphic base G or C
acaataataattactgcatctatsacttgtagagtgctatatactat

SEQ ID NO: 855 - DNA, 47 bp, Homo Sapiens
  allele 24: 99-1781-129 : polymorphic base A or G
tatataagaagtcaccccaaatgraaatttgcagtgacttgttgttt

SEQ ID NO: 856 - DNA, 47 bp, Homo Sapiens
  allele 24: 99-17810-366 : polymorphic base C or T
aatacacttattgttgtataatcygttttttagaggtaaaccttgat

SEQ ID NO: 857 - DNA, 47 bp, Homo Sapiens
  allele 24: 99-17816-377 : polymorphic base G or C
atcccgctgaaccgtacttatttsaaattccatcaccccttaccgtg

SEQ ID NO: 858 - DNA, 47 bp, Homo Sapiens
  allele 24: 99-17820-316 : polymorphic base A or G
atactggcagtgctgaaccacatragaccagctaggaataacgagga

SEQ ID NO: 859 - DNA, 47 bp, Homo Sapiens
  allele 24: 99-17821-109 : polymorphic base A or G
aatacaaaactgcccctccccttrcaggccaccgtaactttctctgc

SEQ ID NO: 860 - DNA, 47 bp, Homo Sapiens
  allele 24: 99-17827-106 : polymorphic base A or C
tactgtctatttctatttctatamtgtctattactattctatttcta

SEQ ID NO: 861 - DNA, 47 bp, Homo Sapiens
  allele 24: 99-17829-412 : polymorphic base G or C
cttaaatctaaatattatctactstcatttgttttctcaatttaatg

SEQ ID NO: 862 - DNA, 47 bp, Homo Sapiens
  allele 24: 99-17833-108 : polymorphic base G or T
aaatagtaagttctagtttaggtktacctttgagctctgagattggc

SEQ ID NO: 863 - DNA, 47 bp, Homo Sapiens
  allele 24: 99-17845-286 : polymorphic base A or G
ccaccacaagaagaaaggaaccarcatggttgacttccagaccaatc

SEQ ID NO: 864 - DNA, 47 bp, Homo Sapiens
  allele 24: 99-17854-229 : polymorphic base C or T
cctgctgagagttcacagcttagyctttctacttctttgccaccttc

SEQ ID NO: 865 - DNA, 47 bp, Homo Sapiens
  allele 24: 99-17856-308 : polymorphic base G or C
agctagctatcttggtcttgcttsggtgttcccactttgaataaaaa

SEQ ID NO: 866 - DNA, 47 bp, Homo Sapiens
  allele 24: 99-17857-251 : polymorphic base A or G
aagggtgttactaggttgtcctcrgtggtgtggaagaatgtacagtt

SEQ ID NO: 867 - DNA, 47 bp, Homo Sapiens
  allele 24: 99-17863-257 : polymorphic base A or G
ttgaggggcagaaaccatgtcctrtgcatttttatattctttaagtc

SEQ ID NO: 868 - DNA, 47 bp, Homo Sapiens
  allele 24: 99-17864-202 : polymorphic base G or T
ctctacttaaaaaaaggcgggggkctttatcattactgttccaactc

SEQ ID NO: 869 - DNA, 47 bp, Homo Sapiens
  allele 24: 99-17866-124 : polymorphic base C or T
tttatctcaattcaaatatacttygattctttaaatcacaattgaac

SEQ ID NO: 870 - DNA, 47 bp, Homo Sapiens
  allele 24: 99-17889-148 : polymorphic base G or C
tcggctccacctagcatgactgastgacttctgccggctcagaaagt

SEQ ID NO: 871 - DNA, 47 bp, Homo Sapiens
  allele 24: 99-17890-58 : polymorphic base C or T
gtgtgttttacacttaaatggtgygtgtggcacacggcaaggcatga

SEQ ID NO: 872 - DNA, 47 bp, Homo Sapiens
  allele 24: 99-17899-140 : polymorphic base A or G
catctctttcacctggtaagcccrggtgtatctttggagcatctcta

SEQ ID NO: 873 - DNA, 47 bp, Homo Sapiens
  allele 24: 99-17913-222 : polymorphic base G or T
accctggctccaagcatcactctkcactgattcttaactaattggag

SEQ ID NO: 874 - DNA, 47 bp, Homo Sapiens
  allele 24: 99-17920-382 : polymorphic base A or G
gataaaatgcatatcatccaaatrttcaatctatattgtgtattctg

SEQ ID NO: 875 - DNA, 47 bp, Homo Sapiens
  allele 24: 99-1793-225 : polymorphic base A or T
gaaggaggagtgaatgagtgtgtwagtccgttcttgcatagctataa

SEQ ID NO: 876 - DNA, 47 bp, Homo Sapiens
  allele 24: 99-17938-131 : polymorphic base A or G
gttgcctagcagcatttctacacrtactacaacatctctgtaaggcc

SEQ ID NO: 877 - DNA, 47 bp, Homo Sapiens
  allele 24: 99-17945-63 : polymorphic base A or T
gtccactatccttaacaataaatwttttcttaaagtagacataatac

SEQ ID NO: 878 - DNA, 47 bp, Homo Sapiens
  allele 24: 99-17946-69 : polymorphic base A or C
actgactcacgggttcctccctcmctgctcctgagggagagctgtcc

SEQ ID NO: 879 - DNA, 47 bp, Homo Sapiens
  allele 24: 99-17952-370 : polymorphic base C or T
ataatggatgccgggccctattaytaatttctgcttagcattcctta

SEQ ID NO: 880 - DNA, 47 bp, Homo Sapiens
  allele 24: 99-1796-184 : polymorphic base A or T
tgtaatagataggtctctttttcwtcattttcagatactaacactct

SEQ ID NO: 881 - DNA, 47 bp, Homo Sapiens
  allele 24: 99-17971-78 : polymorphic base A or G
gtgtttgtatcttataggtcattrataaagattaaaggggcaacgcc

SEQ ID NO: 882 - DNA, 47 bp, Homo Sapiens
  allele 24: 99-17976-132 : polymorphic base G or C
ctcccatgggttcctcattcattsctgtttcagtgttcgctttttat

SEQ ID NO: 883 - DNA, 47 bp, Homo Sapiens
  allele 24: 99-17989-85 : polymorphic base A or G
ttgtgacatccggagcattgatcrctcctatttctttatcttctctt

SEQ ID NO: 884 - DNA, 47 bp, Homo Sapiens
  allele 24: 99-17991-412 : polymorphic base A or T
tagaagcctaaaaattccttgggwtactgtgcagacttgtcacatca

SEQ ID NO: 885 - DNA, 47 bp, Homo Sapiens
  allele 24: 99-17992-404 : polymorphic base A or G
tattcagttattgttgtggcatcrttgatcaacctctggcgcttcat

SEQ ID NO: 886 - DNA, 47 bp, Homo Sapiens
  allele 24: 99-18004-125 : polymorphic base C or T
ttggctcaaattcaactcagtcaygctgcttgccaaagaagaacagt

SEQ ID NO: 887 - DNA, 47 bp, Homo Sapiens
  allele 24: 99-18007-159 : polymorphic base C or T
aactttcctatcttacctatctgygtagctatggaaataggggaaat

SEQ ID NO: 888 - DNA, 47 bp, Homo Sapiens
  allele 24: 99-18030-54 : polymorphic base A or T
attacattttagtacctttaatgwcacttttttctagctttttgaac

SEQ ID NO: 889 - DNA, 47 bp, Homo Sapiens
  allele 24: 99-18038-384 : polymorphic base G or C
ttttgcataatgacaggataaaastatgacttctgcaagaaacacaa

SEQ ID NO: 890 - DNA, 47 bp, Homo Sapiens
  allele 24: 99-18046-65 : polymorphic base A or T
caattgttaattgtgttcttcaawtgttttatgtccttactcattat

SEQ ID NO: 891 - DNA, 47 bp, Homo Sapiens
  allele 24: 99-18053-328 : polymorphic base A or G
acactgttcagctgaggttgcacrgggttaagctatcatacccaagg

SEQ ID NO: 892 - DNA, 47 bp, Homo Sapiens
  allele 24: 99-18054-392 : polymorphic base A or C
ttcttagtgccaagcccagttacmggaagggaacataaagggaaata

SEQ ID NO: 893 - DNA, 47 bp, Homo Sapiens
  allele 24: 99-18056-354 : polymorphic base A or G
gttccaaactcaatttttaaaatrtttatgagtttattacaaagaat

SEQ ID NO: 894 - DNA, 47 bp, Homo Sapiens
  allele 24: 99-18057-55 : polymorphic base A or C
aatattaatttctctggacatgamgggactgtttttctccttataaa

SEQ ID NO: 895 - DNA, 47 bp, Homo Sapiens
  allele 24: 99-18060-203 : polymorphic base G or T
ggttctgcttcaggttctgattckgtgtaaatcatgacttatagccc

SEQ ID NO: 896 - DNA, 47 bp, Homo Sapiens
  allele 24: 99-18062-187 : polymorphic base A or G
agcttctctattttatctggattrcccttcttttaggagctttaaag

SEQ ID NO: 897 - DNA, 47 bp, Homo Sapiens
  allele 24: 99-18069-282 : polymorphic base C or T
agctgacaggaaagtacccagtcyttggggttcagcttgctagactc

SEQ ID NO: 898 - DNA, 47 bp, Homo Sapiens
  allele 24: 99-18079-46 : polymorphic base G or C
gcaaacacacttgtcatgactcascttatccttttattttgttatat

SEQ ID NO: 899 - DNA, 47 bp, Homo Sapiens
  allele 24: 99-1808-291 : polymorphic base A or T
ctccagaacccctagataggaatwggaatttgggcaagattaaaaat

SEQ ID NO: 900 - DNA, 47 bp, Homo Sapiens
  allele 24: 99-18080-378 : polymorphic base G or T
caataataacactgactacttatkatagtgtctgtaatgttctttta

SEQ ID NO: 901 - DNA, 47 bp, Homo Sapiens
  allele 24: 99-18085-94 : polymorphic base A or G
atagacagaacaaaagagatggaraggttacagatatgggagaagtg

SEQ ID NO: 902 - DNA, 47 bp, Homo Sapiens
  allele 24: 99-18086-434 : polymorphic base A or G
cctattttagggccttacactcarttttctagagctctgcaaaccag

SEQ ID NO: 903 - DNA, 47 bp, Homo Sapiens
  allele 24: 99-18087-152 : polymorphic base C or T
gtgcgtatcgatggtattctctayccagaatttctctcccttctttg

SEQ ID NO: 904 - DNA, 47 bp, Homo Sapiens
  allele 24: 99-18091-47 : polymorphic base G or C
ggtgtctaagagagtaaaaaaatsacttctcattccctgttgagaaa

SEQ ID NO: 905 - DNA, 47 bp, Homo Sapiens
  allele 24: 99-18096-198 : polymorphic base C or T
agcttctgacatctcattcagcaygctctaatcctcctaaatgagtt

SEQ ID NO: 906 - DNA, 47 bp, Homo Sapiens
  allele 24: 99-18109-159 : polymorphic base C or T
gcgccactagacactctctaaaayacagccacagcgccagtattggg

SEQ ID NO: 907 - DNA, 47 bp, Homo Sapiens
  allele 24: 99-1813-310 : polymorphic base C or T
ggacaacaaacaagtcttcatttygattttttcagaacagtggaagt

SEQ ID NO: 908 - DNA, 47 bp, Homo Sapiens
  allele 24: 99-18130-258 : polymorphic base A or G
ccaaagccaatgaggaaatgtcgrcggatcatgagctcaatgtttgt

SEQ ID NO: 909 - DNA, 47 bp, Homo Sapiens
  allele 24: 99-1814-245 : polymorphic base A or G
ctctctctctctttaaaatataaraagacaatacttgtgttgattgc

SEQ ID NO: 910 - DNA, 47 bp, Homo Sapiens
  allele 24: 99-18171-95 : polymorphic base G or T
tgtcttcagggactggggggaagkttgggtatctttaagatggcatg

SEQ ID NO: 911 - DNA, 47 bp, Homo Sapiens
  allele 24: 99-18172-284 : polymorphic base A or G
attaaggaaatagagtaaaatacrgtattacagatttcaaactcgtg

SEQ ID NO: 912 - DNA, 47 bp, Homo Sapiens
  allele 24: 99-18179-185 : polymorphic base G or T
tttatctgtccctttgtaaatgtkgtgcttctcctattgttcttgat

SEQ ID NO: 913 - DNA, 47 bp, Homo Sapiens
  allele 24: 99-18198-203 : polymorphic base C or T
agcaaggaataaatactttctctytttatttttcacttctcaaattt

SEQ ID NO: 914 - DNA, 46 bp, Homo Sapiens
  allele 23: 99-18201-23 : polymorphic base A or G
caaatgacaatgcttgttctgtraagaatacaatagcaataagttt

SEQ ID NO: 915 - DNA, 47 bp, Homo Sapiens
  allele 24: 99-18206-76 : polymorphic base A or G
cttcattccgaagatacagcacaragctgatgagcaacgcaatggag

SEQ ID NO: 916 - DNA, 47 bp, Homo Sapiens
  allele 24: 99-18210-30 : polymorphic base G or C
ttgttctcttcactgcaaaactastagaatgcttacatattttaggt

SEQ ID NO: 917 - DNA, 47 bp, Homo Sapiens
  allele 24: 99-18213-185 : polymorphic base A or G
cattagcagacagattggagagtrgtattgatttgttatctatgcat

SEQ ID NO: 918 - DNA, 47 bp, Homo Sapiens
  allele 24: 99-18214-86 : polymorphic base A or C
taggagactttactagaaccactmatctgacttcaggatagtgcgtc

SEQ ID NO: 919 - DNA, 47 bp, Homo Sapiens
  allele 24: 99-18221-207 : polymorphic base C or T
tctattctaacaaggagattttcyttcaggggttgatctaatgtttc

SEQ ID NO: 920 - DNA, 47 bp, Homo Sapiens
  allele 24: 99-1823-157 : polymorphic base A or G
attgttgcagttctatcatgaacractttatgtgccttgtgccactg

SEQ ID NO: 921 - DNA, 47 bp, Homo Sapiens
  allele 24: 99-1824-226 : polymorphic base A or G
atatatatcagactctcaaaggtrgatgtggaaagagattgagaaac

SEQ ID NO: 922 - DNA, 47 bp, Homo Sapiens
  allele 24: 99-18242-369 : polymorphic base A or G
acacaaacaatcttggtagtaacratgatttcgtcaaagacagaatt

SEQ ID NO: 923 - DNA, 47 bp, Homo Sapiens
  allele 24: 99-18253-407 : polymorphic base C or T
tgaattcagatatatctattcctyttttagatcttacctctcagtca

SEQ ID NO: 924 - DNA, 47 bp, Homo Sapiens
  allele 24: 99-18255-259 : polymorphic base A or T
taccctccaaatttacaagcaccwataataatacacacaagaagtga

SEQ ID NO: 925 - DNA, 47 bp, Homo Sapiens
  allele 24: 99-18258-45 : polymorphic base G or C
ttgtggggcagttccaggaaaatsgctgtgctctcactgcaagcttc

SEQ ID NO: 926 - DNA, 47 bp, Homo Sapiens
  allele 24: 99-18268-460 : polymorphic base A or G
gccacaggtatcttcctaaggccrccagagtgagtgatggagcttgg

SEQ ID NO: 927 - DNA, 47 bp, Homo Sapiens
  allele 24: 99-18272-287 : polymorphic base G or C
agtgaacaagggcaaaattgttgscatggcaagaacattttggaaaa

SEQ ID NO: 928 - DNA, 47 bp, Homo Sapiens
  allele 24: 99-18276-390 : polymorphic base A or G
gtaaatatctagaggaataaatgratttacttccaggttactttttt

SEQ ID NO: 929 - DNA, 47 bp, Homo Sapiens
  allele 24: 99-18288-205 : polymorphic base A or G
acaacaacccccttcagcaaagtrggcatgagatgaagagatgtcca

SEQ ID NO: 930 - DNA, 47 bp, Homo Sapiens
  allele 24: 99-18289-36 : polymorphic base C or T
agatgagtyccctgcggacacacytttcagcagcagccagtggggtg

SEQ ID NO: 931 - DNA, 47 bp, Homo Sapiens
  allele 24: 99-18303-79 : polymorphic base C or T
ttgggaaagaaagttccttcctaygaacccctggttcaataggcctg

SEQ ID NO: 932 - DNA, 47 bp, Homo Sapiens
  allele 24: 99-18306-377 : polymorphic base A or G
aggcttttggctccctctcctgtrcaaactactagaaggccccagaa

SEQ ID NO: 933 - DNA, 47 bp, Homo Sapiens
  allele 24: 99-18307-371 : polymorphic base A or C
caggtgttgctagcagtactcatmctgctatgaacaatgacacctta

SEQ ID NO: 934 - DNA, 47 bp, Homo Sapiens
  allele 24: 99-18310-262 : polymorphic base C or T
ccaaccctaggcatatgcaggtgyggcacccctaggagggaacttta

SEQ ID NO: 935 - DNA, 47 bp, Homo Sapiens
  allele 24: 99-18312-58 : polymorphic base C or T
aagtggttcatgtcctaatcttgygtttatgaaatgtgttaatatct

SEQ ID NO: 936 - DNA, 47 bp, Homo Sapiens; identical to SEQ ID NO: 910
  allele 24: 99-18341-95 : polymorphic base G or T

SEQ ID NO: 937 - DNA, 47 bp, Homo Sapiens; identical to SEQ ID NO: 911
  allele 24: 99-18344-284 : polymorphic base A or G

SEQ ID NO: 938 - DNA, 47 bp, Homo Sapiens
  allele 24: 99-18345-107 : polymorphic base C or T
aaaatatttgtggatacagatttyggagatctctaagcctatgccta

SEQ ID NO: 939 - DNA, 47 bp, Homo Sapiens
  allele 24: 99-18371-433 : polymorphic base A or T
tatttgtatattcatacacatgtwtgaatcacgtgtatatatgtatg

SEQ ID NO: 940 - DNA, 47 bp, Homo Sapiens
  allele 24: 99-18373-27 : polymorphic base A or G
tatagcttatgagcaccaactccrgaggtaggttttgtgtctgaaca

SEQ ID NO: 941 - DNA, 47 bp, Homo Sapiens
  allele 24: 99-18375-237 : polymorphic base A or G
gcataatatagtaatagtatattrgatgtatgtgttcagaaatattt

SEQ ID NO: 942 - DNA, 47 bp, Homo Sapiens
  allele 24: 99-18379-485 : polymorphic base C or T
tctattcatttaaagcaatgagcyttcaaatgttataacgtaaactg

SEQ ID NO: 943 - DNA, 47 bp, Homo Sapiens
  allele 24: 99-18386-177 : polymorphic base A or T
taccatgcctgtgggcagcactgwatatgtaattgctgggaacattc

SEQ ID NO: 944 - DNA, 47 bp, Homo Sapiens
  allele 24: 99-18394-132 : polymorphic base G or T
tcttttcttaagctgataagtagktgtctattctttgcaagtaaaat

SEQ ID NO: 945 - DNA, 47 bp, Homo Sapiens
  allele 24: 99-18402-255 : polymorphic base C or T
ccaaaggactagcatttcaggctygttagtggctaagagcctgctcc

SEQ ID NO: 946 - DNA, 47 bp, Homo Sapiens
  allele 24: 99-18406-155 : polymorphic base A or G
agatgtgagaagtcaaaaatcctrttgcgatctcattttgcagggaa

SEQ ID NO: 947 - DNA, 47 bp, Homo Sapiens
  allele 24: 99-18414-204 : polymorphic base A or C
cgataacattagaaaataagaagmccagtcctcaactctgtgaagaa

SEQ ID NO: 948 - DNA, 47 bp, Homo Sapiens
  allele 24: 99-18418-127 : polymorphic base G or C
tactgaaaccaagcttcctgtagsctgctcccagccaacgactgaga

SEQ ID NO: 949 - DNA, 47 bp, Homo Sapiens
  allele 24: 99-1842-78 : polymorphic base C or T
aaatctttcttgagctaatttatyagtacatctcccaagattattta

SEQ ID NO: 950 - DNA, 47 bp, Homo Sapiens
  allele 24: 99-18423-336 : polymorphic base A or G
cacaggtgcttgtgtctatcaggrttccttgttggcggtaggtcatt

SEQ ID NO: 951 - DNA, 47 bp, Homo Sapiens
  allele 24: 99-18427-314 : polymorphic base C or T
attcaatgctaaaaatttagaacyccaccatgacatgtacatgtatg

SEQ ID NO: 952 - DNA, 47 bp, Homo Sapiens
  allele 24: 99-18438-398 : polymorphic base C or T
agcttctgtcatgttttttcttaygtaagtccaacttttgccggtta

SEQ ID NO: 953 - DNA, 47 bp, Homo Sapiens
  allele 24: 99-18442-283 : polymorphic base C or T
agttagatgataccatcttaatayacagtaatttagaaatcactaga

SEQ ID NO: 954 - DNA, 47 bp, Homo Sapiens
  allele 24: 99-18444-185 : polymorphic base C or T
agcatgatctgccaggaaggaccygggagcagcaggatttagatgca

SEQ ID NO: 955 - DNA, 47 bp, Homo Sapiens
  allele 24: 99-18458-191 : polymorphic base A or G
atgcttcccgtcactgaaacaagratccttactctttcaacacggtg

SEQ ID NO: 956 - DNA, 47 bp, Homo Sapiens
  allele 24: 99-18470-119 : polymorphic base A or T
ggcaaagatcagtgctcagaaagwcaggttttgtcattattcagtca

SEQ ID NO: 957 - DNA, 47 bp, Homo Sapiens
  allele 24: 99-18478-101 : polymorphic base A or G
agaagaaagggactggcttgagcrttggatagatccagggactggac

SEQ ID NO: 958 - DNA, 47 bp, Homo Sapiens
  allele 24: 99-18486-49 : polymorphic base A or G
ttgcttcctcaccattctggaagrtgcaggtgtcatcaggaagcaaa

SEQ ID NO: 959 - DNA, 47 bp, Homo Sapiens
  allele 24: 99-18487-236 : polymorphic base C or T
aggatctccaagtctagctggaaygataaacaatttgatccacaata

SEQ ID NO: 960 - DNA, 47 bp, Homo Sapiens
  allele 24: 99-18488-273 : polymorphic base A or G
ttcttggtctgcagggaggtcacrggcttgtagggatgagagataat

SEQ ID NO: 961 - DNA, 47 bp, Homo Sapiens
  allele 24: 99-1849-421 : polymorphic base C or T
aggagcagttttaagaagcacacygtcaatgttgtaatgggttttga

SEQ ID NO: 962 - DNA, 47 bp, Homo Sapiens
  allele 24: 99-18536-290 : polymorphic base G or T
ctctggcaaagaatttagaggggkaaataactcaaatcaatgccatc

SEQ ID NO: 963 - DNA, 47 bp, Homo Sapiens
  allele 24: 99-18542-232 : polymorphic base A or C
gatctaacagccatttctaattcmcttttcctttgtctcccccacac

SEQ ID NO: 964 - DNA, 47 bp, Homo Sapiens
  allele 24: 99-18551-389 : polymorphic base G or C
cccagctgaagaactgaatttcasaggtctgacactgacacaaccca

SEQ ID NO: 965 - DNA, 47 bp, Homo Sapiens
  allele 24: 99-18561-371 : polymorphic base A or C
tctcatgaaaatcctccctgatamaatagaaggcatggatttacgtt

SEQ ID NO: 966 - DNA, 47 bp, Homo Sapiens
  allele 24: 99-18573-363 : polymorphic base G or T
aagctttctataaatggcaggacktgaactgggctttgatttaggct

SEQ ID NO: 967 - DNA, 47 bp, Homo Sapiens
  allele 24: 99-18582-422 : polymorphic base A or G
tgagaaaacaagacacacacttgraaaacatcaataataaggtgaaa

SEQ ID NO: 968 - DNA, 47 bp, Homo Sapiens
  allele 24: 99-18588-175 : polymorphic base A or C
aaatataaaaaggaaggccagagmgaataggaarcatcataaggcaa

SEQ ID NO: 969 - DNA, 47 bp, Homo Sapiens
  allele 24: 99-18596-83 : polymorphic base A or G
acttcacctgcttgagagaatacraggagaagggtatggagggagaa

SEQ ID NO: 970 - DNA, 47 bp, Homo Sapiens
  allele 24: 99-18597-415 : polymorphic base C or T
cgcatggattgttctcagtaccayactctctggacagaggcccaaaa

SEQ ID NO: 971 - DNA, 47 bp, Homo Sapiens
  allele 24: 99-18599-347 : polymorphic base A or G
tatgcctctaatctaagggccttrtcaccaccttagtttttaacgtg

SEQ ID NO: 972 - DNA, 47 bp, Homo Sapiens
  allele 24: 99-1860-281 : polymorphic base A or G
tttggggtcttttcagggaaggtrggaattatatacattttaaaggt

SEQ ID NO: 973 - DNA, 47 bp, Homo Sapiens
  allele 24: 99-18602-241 : polymorphic base A or G
cacaacaatcctctaatgtaggcrggaaactactaccaccctcaggt

SEQ ID NO: 974 - DNA, 47 bp, Homo Sapiens
  allele 24: 99-18606-324 : polymorphic base C or T
aataaggaagaatttttttttaaytggaagatatgctgaacagatta

SEQ ID NO: 975 - DNA, 47 bp, Homo Sapiens
  allele 24: 99-1861-191 : polymorphic base G or C
ccagtcatcttggccaatagaatsttttcagctccaggattaatcat

SEQ ID NO: 976 - DNA, 47 bp, Homo Sapiens
  allele 24: 99-18612-184 : polymorphic base C or T
aaaactgcctgcctgccgcctcayggggaattgctcttaattgtttg

SEQ ID NO: 977 - DNA, 47 bp, Homo Sapiens
  allele 24: 99-18618-455 : polymorphic base C or T
ccccatttgtcagagaacctaccygcttttcagtgacatttatactc

SEQ ID NO: 978 - DNA, 47 bp, Homo Sapiens
  allele 24: 99-18620-125 : polymorphic base C or T
tgatgtagaaagctgcctcgccayggatgtaacgctgtggctgtcac

SEQ ID NO: 979 - DNA, 47 bp, Homo Sapiens
  allele 24: 99-18637-281 : polymorphic base C or T
tccatctgtgtcacaggctcattygatcatcacagataccttctcca

SEQ ID NO: 980 - DNA, 47 bp, Homo Sapiens
  allele 24: 99-18638-164 : polymorphic base C or T
tacttgccaaataacatggtttayactgtctttcaggtgagaaaagg

SEQ ID NO: 981 - DNA, 47 bp, Homo Sapiens
  allele 24: 99-18640-458 : polymorphic base C or T
aggtttcactgcaatatgtggcayttgagatctttaaatccctgctc

SEQ ID NO: 982 - DNA, 47 bp, Homo Sapiens
  allele 24: 99-18648-71 : polymorphic base C or T
aaatgtcccactaggcaatttctycttcatagcttccattttcacta

SEQ ID NO: 983 - DNA, 47 bp, Homo Sapiens
  allele 24: 99-18666-483 : polymorphic base G or T
tacaccttttagttctcaccaatkgtgtaggtatcgctgtccctact

SEQ ID NO: 984 - DNA, 47 bp, Homo Sapiens
  allele 24: 99-18667-392 : polymorphic base G or C
caagtgctgggctgtcacctgggstacaaagtgaagtggctcctgac

SEQ ID NO: 985 - DNA, 47 bp, Homo Sapiens
  allele 24: 99-18669-223 : polymorphic base G or C
ccagccctgctgttggacagcttsgtggccctgggcaaattacttag

SEQ ID NO: 986 - DNA, 47 bp, Homo Sapiens
  allele 24: 99-18715-172 : polymorphic base A or G
aaaagacatatgggtgggatgagracgaatgattcttactttatctg

SEQ ID NO: 987 - DNA, 47 bp, Homo Sapiens
  allele 24: 99-18719-225 : polymorphic base C or T
ggaaacagaaaaatgtgcaggacyttcctttgggggttctgtcacat

SEQ ID NO: 988 - DNA, 47 bp, Homo Sapiens
  allele 24: 99-18720-235 : polymorphic base C or T
acttaatactgtatttctcagtcytaatgactgtgccagtgagttca

SEQ ID NO: 989 - DNA, 47 bp, Homo Sapiens
  allele 24: 99-18721-442 : polymorphic base A or G
taatacctggtgccatttatatartatactaatatgctcttattgtg

SEQ ID NO: 990 - DNA, 47 bp, Homo Sapiens
  allele 24: 99-18724-409 : polymorphic base C or T
taaactcctggttcacataaggtygtgggaactaagatatgaggtga

SEQ ID NO: 991 - DNA, 47 bp, Homo Sapiens
  allele 24: 99-18729-377 : polymorphic base A or T
gaaagatgtacattagtggtagtwctttaaaaaaaaaaacatggaat

SEQ ID NO: 992 - DNA, 47 bp, Homo Sapiens
  allele 24: 99-1873-193 : polymorphic base C or T
gggttgagtctccctcatgcttcygatctgtttccttttttcttttt

SEQ ID NO: 993 - DNA, 47 bp, Homo Sapiens
  allele 24: 99-18744-170 : polymorphic base A or G
tgggatttccccatcacaggaggrtcttgccagagcccacaggaaga

SEQ ID NO: 994 - DNA, 47 bp, Homo Sapiens
  allele 24: 99-18745-423 : polymorphic base A or G
gaaccacatgctcacaggcactgragcaggaaatatcttggcaagaa

SEQ ID NO: 995 - DNA, 47 bp, Homo Sapiens
  allele 24: 99-18747-72 : polymorphic base C or T
cagtgagtgcctgatcccagcccyccctgcctaccttctttctgtct

SEQ ID NO: 996 - DNA, 47 bp, Homo Sapiens
  allele 24: 99-18751-217 : polymorphic base G or T
tgtcaaatagctcctttctgtttkgattgttctattttcatgatata

SEQ ID NO: 997 - DNA, 47 bp, Homo Sapiens
  allele 24: 99-18755-267 : polymorphic base C or T
ttctactctagactcactgttttyctgaagtgggaagagggtgaggg

SEQ ID NO: 998 - DNA, 47 bp, Homo Sapiens
  allele 24: 99-18774-69 : polymorphic base G or T
catcagctccctggataaaacctkttgttgaattgtgaaagtagcta

SEQ ID NO: 999 - DNA, 47 bp, Homo Sapiens
  allele 24: 99-18775-161 : polymorphic base G or T
aggcttgctggaatcttaaatctkgaatgatccccttgactctcagg

SEQ ID NO: 1000 - DNA, 47 bp, Homo Sapiens
  allele 24: 99-18777-130 : polymorphic base C or T
ctccttctcctcgaagggtacaaytcataaacatttcttgtgattac

SEQ ID NO: 1001 - DNA, 47 bp, Homo Sapiens
  allele 24: 99-18802-308 : polymorphic base G or C
tgtttccagggaaactaaggtaasaagagaagattgcagaagctctc

SEQ ID NO: 1002 - DNA, 47 bp, Homo Sapiens
  allele 24: 99-18808-155 : polymorphic base C or T
attggtcaggctggtctcaaactyctgacttcaggtgatccgcctgc

SEQ ID NO: 1003 - DNA, 47 bp, Homo Sapiens
  allele 24: 99-18814-275 : polymorphic base G or C
tctgagggttcatgctttagagasagaacaatatgggacaatctaca

SEQ ID NO: 1004 - DNA, 47 bp, Homo Sapiens
  allele 24: 99-1882-289 : polymorphic base C or T
atcatgcttagaggtgtgggttayacagttatatgtgattatcaaaa

SEQ ID NO: 1005 - DNA, 47 bp, Homo Sapiens
  allele 24: 99-18822-368 : polymorphic base C or T
cactgaggagttgagctcattcayacaggcttttatcatgcttaatt

SEQ ID NO: 1006 - DNA, 47 bp, Homo Sapiens
  allele 24: 99-18826-378 : polymorphic base C or T
ccagaagtatcattagtaaaggaytgatagtcacttctgttagctat

SEQ ID NO: 1007 - DNA, 47 bp, Homo Sapiens
  allele 24: 99-18827-92 : polymorphic base A or G
ttccataaatgtctgaagcctacraacttgaaataaattctctgttc

SEQ ID NO: 1008 - DNA, 47 bp, Homo Sapiens
  allele 24: 99-1883-121 : polymorphic base G or T
agaataaatcaataactgactgakaaatcacttctatgattttaagt

SEQ ID NO: 1009 - DNA, 47 bp, Homo Sapiens
  allele 24: 99-18847-263 : polymorphic base C or T
actgaaaatgggatttaatatatyatattctaatgtcaatgctaaac

SEQ ID NO: 1010 - DNA, 47 bp, Homo Sapiens
  allele 24: 99-18853-64 : polymorphic base G or T
ctagccagttggtaccagggcaaktctgaagccacaagatggcagag

SEQ ID NO: 1011 - DNA, 47 bp, Homo Sapiens
  allele 24: 99-18855-173 : polymorphic base A or G
cttattatgtgttacaggtagcarctacagctgaaggccatggtgaa

SEQ ID NO: 1012 - DNA, 47 bp, Homo Sapiens
  allele 24: 99-18860-308 : polymorphic base C or T
agccccttctgtgtcagcacatgycacagagtcaggcttccagaaag

SEQ ID NO: 1013 - DNA, 46 bp, Homo Sapiens
  allele 23: 99-18861-23 : polymorphic base C or T
aaatagcaacgtcccctctagaycttgagatgaaacttggctataa

SEQ ID NO: 1014 - DNA, 47 bp, Homo Sapiens
  allele 24: 99-1888-162 : polymorphic base C or T
gtttcttcaagagaaattacaggygcctacctatccctgagaagtag

SEQ ID NO: 1015 - DNA, 47 bp, Homo Sapiens
  allele 24: 99-1890-125 : polymorphic base C or T
tattaatcaattacacaactcatygatattatcaggattattcaata

SEQ ID NO: 1016 - DNA, 47 bp, Homo Sapiens
  allele 24: 99-1895-67 : polymorphic base A or C
tgaaccaaaaattagtgtattttmtcttttaaaatgtagttagtaaa

SEQ ID NO: 1017 - DNA, 47 bp, Homo Sapiens
  allele 24: 99-18974-99 : polymorphic base A or G
ttgtgcatccgtctagtccccctrttacgcgtttacaggaatatggt

SEQ ID NO: 1018 - DNA, 47 bp, Homo Sapiens
  allele 24: 99-18976-135 : polymorphic base A or T
aagtttgtactttagacacatcawgcttgattggtaacttccctcct

SEQ ID NO: 1019 - DNA, 47 bp, Homo Sapiens
  allele 24: 99-18982-345 : polymorphic base C or T
caatcgccatcactttacatcttyttctcctgctaatccaccgagtc

SEQ ID NO: 1020 - DNA, 47 bp, Homo Sapiens
  allele 24: 99-18986-248 : polymorphic base G or C
actttgaaggaaaaggcgtttgasgtaggagctttatgctgactggg

SEQ ID NO: 1021 - DNA, 47 bp, Homo Sapiens
  allele 24: 99-18987-191 : polymorphic base A or G
aaaaattcatttagttagaagggrgaagaatgaaaaatgtgagatgg

SEQ ID NO: 1022 - DNA, 47 bp, Homo Sapiens
  allele 24: 99-18995-300 : polymorphic base C or T
aatgtacaaaaaatgtaactttayagaaaacctttgaccttcatttt

SEQ ID NO: 1023 - DNA, 47 bp, Homo Sapiens
  allele 24: 99-18996-388 : polymorphic base A or G
taatattgtgaattttatattcarcaatactttttgtgcataatcag

SEQ ID NO: 1024 - DNA, 47 bp, Homo Sapiens
  allele 24: 99-19008-237 : polymorphic base C or T
ggattctgctcctgattctctacyagaccaggcctctctgcccttct

SEQ ID NO: 1025 - DNA, 47 bp, Homo Sapiens
  allele 24: 99-19013-384 : polymorphic base C or T
ccacagcaggtgacattcctaagyttgtatgcatgtgccagcacaca

SEQ ID NO: 1026 - DNA, 47 bp, Homo Sapiens
  allele 24: 99-19016-51 : polymorphic base A or G
gatgtggcccagcagacaatccargcaaaggagccctgctgccatgg

SEQ ID NO: 1027 - DNA, 47 bp, Homo Sapiens
  allele 24: 99-1909-387 : polymorphic base G or T
ttctcaaacgacaacacaaaaatkaaaaatacatgctgcagcctgaa

SEQ ID NO: 1028 - DNA, 47 bp, Homo Sapiens
  allele 24: 99-1910-94 : polymorphic base C or T
atgtattgcaacaaaatgtaaaayaaaaagacacttttaagaagagc

SEQ ID NO: 1029 - DNA, 47 bp, Homo Sapiens
  allele 24: 99-1916-91 : polymorphic base G or T
ctctgcaacagtttataagatagktctgttgcttttcctttagcatt

SEQ ID NO: 1030 - DNA, 47 bp, Homo Sapiens
  allele 24: 99-1917-434 : polymorphic base A or T
gtcatctaacaaacttggggctawaaatgaatgtagccgtatcacct

SEQ ID NO: 1031 - DNA, 47 bp, Homo Sapiens
  allele 24: 99-19253-102 : polymorphic base A or G
ttttcatgatgtgaccgacaaatragatccaaagtatcaaataactg

SEQ ID NO: 1032 - DNA, 47 bp, Homo Sapiens
  allele 24: 99-19256-149 : polymorphic base C or T
tgagctcttgtttactacagatayttagtttgcttatcaaatatttt

SEQ ID NO: 1033 - DNA, 47 bp, Homo Sapiens
  allele 24: 99-1934-272 : polymorphic base A or G
ttaaatggacataaagttgccatrccatttgcaaagtataagacttc

SEQ ID NO: 1034 - DNA, 47 bp, Homo Sapiens
  allele 24: 99-1936-289 : polymorphic base C or T
ctattggcttttggaggtaactaytttcaggttgtggaagtttcact

SEQ ID NO: 1035 - DNA, 47 bp, Homo Sapiens
  allele 24: 99-1944-379 : polymorphic base C or T
ataagccagtcatttaacactttygtgaataatttaaatagcacaaa

SEQ ID NO: 1036 - DNA, 47 bp, Homo Sapiens
  allele 24: 99-1947-205 : polymorphic base A or G
ttcatgccagtaactcagcctccraagggtgccagagggactgagct

SEQ ID NO: 1037 - DNA, 47 bp, Homo Sapiens
  allele 24: 99-1948-49 : polymorphic base G or C
gatttgcagtaatagagttcactstattctattattattactttaat

SEQ ID NO: 1038 - DNA, 47 bp, Homo Sapiens
  allele 24: 99-1953-287 : polymorphic base A or G
cactttgaggctgatttttatttrcctaaaaccacctactattatcc

SEQ ID NO: 1039 - DNA, 47 bp, Homo Sapiens
  allele 24: 99-1955-443 : polymorphic base A or G
tggaccacatctgttctaaaaatrtgtctcctactttgccttctttt

SEQ ID NO: 1040 - DNA, 47 bp, Homo Sapiens
  allele 24: 99-1960-424 : polymorphic base A or T
aaacaactatgaaatatggctgtwcttattttatccacatcatttgt

SEQ ID NO: 1041 - DNA, 47 bp, Homo Sapiens
  allele 24: 99-1964-53 : polymorphic base C or T
ttcctttctcttaaaaccctcttyccatttgctttctaagatgccac

SEQ ID NO: 1042 - DNA, 47 bp, Homo Sapiens
  allele 24: 99-1977-440 : polymorphic base A or G
agctaaaacttgactaggtcctargcattcttagctatggaccatgt

SEQ ID NO: 1043 - DNA, 47 bp, Homo Sapiens
  allele 24: 99-1997-139 : polymorphic base G or T
ccttttcatttttataataggggkttttttaatgaacacatgattta

SEQ ID NO: 1044 - DNA, 47 bp, Homo Sapiens
  allele 24: 99-19999-92 : polymorphic base C or T
atggacatttagcttgcttccagygtttgctgttgtatataatactg

SEQ ID NO: 1045 - DNA, 47 bp, Homo Sapiens
  allele 24: 99-2000-240 : polymorphic base G or T
attgaaatgcaaatctattctaakgcaattgatatagtagggagaaa

SEQ ID NO: 1046 - DNA, 47 bp, Homo Sapiens
  allele 24: 99-20000-252 : polymorphic base A or G
tctgaaggagtataggctcctgcrgtagagagtaggtgtgggggtgg

SEQ ID NO: 1047 - DNA, 47 bp, Homo Sapiens
  allele 24: 99-2001-177 : polymorphic base A or G
atacaaagtgtatgtgcaaacacrcagttgaacgttcagccatagtt

SEQ ID NO: 1048 - DNA, 47 bp, Homo Sapiens
  allele 24: 99-20011-229 : polymorphic base C or T
cgctgaccttgagttggaatggcyctgctctaaaaggtaagaaccaa

SEQ ID NO: 1049 - DNA, 47 bp, Homo Sapiens
  allele 24: 99-20018-244 : polymorphic base G or C
cactaactgctataatagcaaagstccaaaatcttaatggtttaaca

SEQ ID NO: 1050 - DNA, 47 bp, Homo Sapiens
  allele 24: 99-20023-386 : polymorphic base A or T
ctgacctgcttgtagtccagaaawgccatgtacaagaggaagcattc

SEQ ID NO: 1051 - DNA, 47 bp, Homo Sapiens
  allele 24: 99-2003-509 : polymorphic base G or C
cagcttcatttcccccagcccctstttgcgctggactcgctctggtt

SEQ ID NO: 1052 - DNA, 47 bp, Homo Sapiens
  allele 24: 99-20032-90 : polymorphic base G or T
tatgtctgactttttggcaagtakttacctctaaaagtctcagtttc

SEQ ID NO: 1053 - DNA, 47 bp, Homo Sapiens
  allele 24: 99-20033-186 : polymorphic base G or T
ttccacacagagaaggaaatgcgkcttacacagcagtgcgagacaga

SEQ ID NO: 1054 - DNA, 47 bp, Homo Sapiens
  allele 24: 99-20035-283 : polymorphic base A or C
ttgcataagaagactgatacgatmagattttctttgagaaagcttac

SEQ ID NO: 1055 - DNA, 47 bp, Homo Sapiens
  allele 24: 99-2004-35 : polymorphic base C or T
acatcaccagaggggaaaacaacyggcacagatacatcagtagcaga

SEQ ID NO: 1056 - DNA, 47 bp, Homo Sapiens
  allele 24: 99-2005-466 : polymorphic base G or C
tcattatggttgtgataggtgaasctagagagagtaataaagtgata

SEQ ID NO: 1057 - DNA, 47 bp, Homo Sapiens
  allele 24: 99-20057-166 : polymorphic base C or T
aataaatgaagcataaaaccttcyaaacagtactgtacaatgaatct

SEQ ID NO: 1058 - DNA, 47 bp, Homo Sapiens
  allele 24: 99-20061-56 : polymorphic base C or T
acataaccaggtctcaagtgctgyccattaagcaatacagtaaagag

SEQ ID NO: 1059 - DNA, 47 bp, Homo Sapiens
  allele 24: 99-20062-181 : polymorphic base A or G
gcacaatactgaacaaaacacacrtggtccctgcccgtaccagggta

SEQ ID NO: 1060 - DNA, 47 bp, Homo Sapiens
  allele 24: 99-2007-278 : polymorphic base C or T
attaatctcataccattgtatttyatcttcataacaagcctctgagg

SEQ ID NO: 1061 - DNA, 47 bp, Homo Sapiens
  allele 24: 99-20074-154 : polymorphic base A or C
caggctcctgtcagaccaggaccmtacattcattccaagtgaatggg

SEQ ID NO: 1062 - DNA, 47 bp, Homo Sapiens
  allele 24: 99-20090-81 : polymorphic base A or C
gtgactcctttctcgtgcatgtamgtttaccgtcatgccagcaagtc

SEQ ID NO: 1063 - DNA, 47 bp, Homo Sapiens
  allele 24: 99-2010-363 : polymorphic base C or T
gggctgccttacatatggagagtytgtagtggaccaaactggcaggc

SEQ ID NO: 1064 - DNA, 47 bp, Homo Sapiens
  allele 24: 99-20110-65 : polymorphic base G or T
ctgttgacatggcataatctaatkggaaaatttgccagaaaccaaga

SEQ ID NO: 1065 - DNA, 47 bp, Homo Sapiens
  allele 24: 99-2012-243 : polymorphic base A or G
ccagattgctcagacagtgtggartcgatcatgcctgcatagctgtc

SEQ ID NO: 1066 - DNA, 47 bp, Homo Sapiens
  allele 24: 99-20154-451 : polymorphic base A or T
tacgattattttccctctttttcwaatgaggaacctcaggtttagag

SEQ ID NO: 1067 - DNA, 47 bp, Homo Sapiens
  allele 24: 99-20156-212 : polymorphic base A or G
ctaagctaacatttcagaaccacrgttttaacacatctattctaaag

SEQ ID NO: 1068 - DNA, 47 bp, Homo Sapiens
  allele 24: 99-20198-54 : polymorphic base C or T
atgggacgacccacactagatgcyggtggtgccatgctcttggactt

SEQ ID NO: 1069 - DNA, 47 bp, Homo Sapiens
  allele 24: 99-2020-281 : polymorphic base C or T
ttttccagttattcatatgatatytgatagactgtagttgctcaatg

SEQ ID NO: 1070 - DNA, 47 bp, Homo Sapiens
  allele 24: 99-20208-176 : polymorphic base A or G
aacatgggataatattgtattaartatgataaacagtatttaatctc

SEQ ID NO: 1071 - DNA, 47 bp, Homo Sapiens
  allele 24: 99-2022-200 : polymorphic base A or C
tgtagatagctgcccattcacctmttcagaaagcaggctttagtagt

SEQ ID NO: 1072 - DNA, 47 bp, Homo Sapiens
  allele 24: 99-2024-132 : polymorphic base A or G
tcccactgctattttgtggctatrtactgtccgggtagtgtcaataa

SEQ ID NO: 1073 - DNA, 47 bp, Homo Sapiens
  allele 24: 99-2025-234 : polymorphic base C or T
gttatgagttcatcaaggcagaaytcttcacttccactgaatatcaa

SEQ ID NO: 1074 - DNA, 47 bp, Homo Sapiens
  allele 24: 99-20250-362 : polymorphic base A or T
tggttgacagtggacagtttggtwgcagtagggactccagatggtga

SEQ ID NO: 1075 - DNA, 47 bp, Homo Sapiens
  allele 24: 99-2027-296 : polymorphic base A or G
caagcaatgtggccggggagaatrtacatgcagatggatacatctgt

SEQ ID NO: 1076 - DNA, 47 bp, Homo Sapiens
  allele 24: 99-20294-274 : polymorphic base C or T
ccatctcacatttttcattcttcycccttctaactaaatgaattttt

SEQ ID NO: 1077 - DNA, 47 bp, Homo Sapiens
  allele 24: 99-20303-127 : polymorphic base C or T
tttgaccttcataagtagtgcatyctgagacttcctcaaattcccaa

SEQ ID NO: 1078 - DNA, 47 bp, Homo Sapiens
  allele 24: 99-20313-311 : polymorphic base A or G
aaactttacaatacttggttttcrtaacaatttttaccaggaaataa

SEQ ID NO: 1079 - DNA, 47 bp, Homo Sapiens
  allele 24: 99-20320-321 : polymorphic base C or T
aagggagggataaacatgagccaygcctgggagacagtttgtatatt

SEQ ID NO: 1080 - DNA, 47 bp, Homo Sapiens
  allele 24: 99-20326-130 : polymorphic base A or G
tttgctctccttcatcatcccagrtccagctatccatcagaaagtct

SEQ ID NO: 1081 - DNA, 47 bp, Homo Sapiens
  allele 24: 99-20332-432 : polymorphic base A or G
tttttctaaagcaaaccttagtcrtaatctactctgttctaaagtgt

SEQ ID NO: 1082 - DNA, 47 bp, Homo Sapiens
  allele 24: 99-20335-48 : polymorphic base C or T
gacagtttttctttttaaatagcyagtctagcatttatctgtctatt

SEQ ID NO: 1083 - DNA, 47 bp, Homo Sapiens
  allele 24: 99-20340-161 : polymorphic base A or G
ttttgctctttctactgaaagtgrgtggtggttatgtctctgaacat

SEQ ID NO: 1084 - DNA, 47 bp, Homo Sapiens
  allele 24: 99-20348-403 : polymorphic base A or G
tcaaccaataaattccttgattgrgaggatttttagttttattttat

SEQ ID NO: 1085 - DNA, 47 bp, Homo Sapiens
  allele 24: 99-2035-323 : polymorphic base C or T
ctttactgaagggattattgcagygtccaacacacctgccacacctg

SEQ ID NO: 1086 - DNA, 47 bp, Homo Sapiens
  allele 24: 99-20353-229 : polymorphic base A or G
caccttccatttgctctgtactcrctaggtacctgccatgtgctttc

SEQ ID NO: 1087 - DNA, 47 bp, Homo Sapiens
  allele 24: 99-20357-359 : polymorphic base A or T
atgggtagaaagtgggtagaaagwgttatccacaaagacagatactg

SEQ ID NO: 1088 - DNA, 47 bp, Homo Sapiens
  allele 24: 99-2036-168 : polymorphic base A or T
aggaatatggcattaggattgctwggccaaaccccaggagtgattgg

SEQ ID NO: 1089 - DNA, 47 bp, Homo Sapiens
  allele 24: 99-2037-470 : polymorphic base C or T
tagcgaggagtggcttaaatcagytgaatattcagagctggtaaaac

SEQ ID NO: 1090 - DNA, 47 bp, Homo Sapiens
  allele 24: 99-20385-215 : polymorphic base C or T
gtttggtgtgaagattaagttaaytaatacatgtaaagcacttagaa

SEQ ID NO: 1091 - DNA, 47 bp, Homo Sapiens
  allele 24: 99-2041-141 : polymorphic base A or G
aagtctgcatttatagcctttatrctacccaccctcctatccaaaga

SEQ ID NO: 1092 - DNA, 47 bp, Homo Sapiens
  allele 24: 99-2042-439 : polymorphic base G or C
ctgtattagtccattttcacactsttataaacaactgcctgagaccg

SEQ ID NO: 1093 - DNA, 47 bp, Homo Sapiens; identical to SEQ ID NO: 1076
  allele 24: 99-20420-274 : polymorphic base C or T

SEQ ID NO: 1094 - DNA, 47 bp, Homo Sapiens
  allele 24: 99-20423-430 : polymorphic base C or T
ttatttcctggtaaaaattgttaygaaaaccaagtattgtaaagttt

SEQ ID NO: 1095 - DNA, 47 bp, Homo Sapiens
  allele 24: 99-20424-330 : polymorphic base C or T
tgatgcttggcaagctctagtcayaacaaagcagcctcagaaaggcc

SEQ ID NO: 1096 - DNA, 47 bp, Homo Sapiens
  allele 24: 99-20428-271 : polymorphic base C or T
ctgattatgcacaaaaagtattgytgaatataaaattcacaatatta

SEQ ID NO: 1097 - DNA, 47 bp, Homo Sapiens
  allele 24: 99-2043-220 : polymorphic base A or T
agttattagaagtcagactctttwtgtaacctcccattagggcagga

SEQ ID NO: 1098 - DNA, 47 bp, Homo Sapiens
  allele 24: 99-2046-275 : polymorphic base A or G
ttcattttgtgagtcagattttargaccttggaatgatggttttaag

SEQ ID NO: 1099 - DNA, 47 bp, Homo Sapiens
  allele 24: 99-20469-213 : polymorphic base C or T
tatttttgtaaataaagttttgtygaaacaccgccacatccattcat

SEQ ID NO: 1100 - DNA, 47 bp, Homo Sapiens
  allele 24: 99-2048-267 : polymorphic base G or C
tgtgaagaagttgccggcctcccstctccctctgcggtgatgataag

SEQ ID NO: 1101 - DNA, 47 bp, Homo Sapiens
  allele 24: 99-20480-233 : polymorphic base C or T
attaataaagtcatgaaccctgayggtttgcagaactcgccacagag

SEQ ID NO: 1102 - DNA, 47 bp, Homo Sapiens
  allele 24: 99-20481-131 : polymorphic base G or C
gtcaaccaataattagttatcgtsgctctgctttaaccccaggacat

SEQ ID NO: 1103 - DNA, 47 bp, Homo Sapiens
  allele 24: 99-20485-269 : polymorphic base A or G
aggtaacatttttctttactattrttttaaaattagatgtgatttaa

SEQ ID NO: 1104 - DNA, 47 bp, Homo Sapiens
  allele 24: 99-20493-238 : polymorphic base G or T
ccttattttccttctttcttcagkattgtggggaaactgtcagtgct

SEQ ID NO: 1105 - DNA, 47 bp, Homo Sapiens
  allele 24: 99-20499-364 : polymorphic base A or T
tccttccttttggaggttctcctwcttctcatcttttatggattcta

SEQ ID NO: 1106 - DNA, 47 bp, Homo Sapiens
  allele 24: 99-20504-90 : polymorphic base A or G
ttccctgattatgttcccttctcrcctgtttaatcaggtttcagctc

SEQ ID NO: 1107 - DNA, 47 bp, Homo Sapiens
  allele 24: 99-20508-456 : polymorphic base C or T
aatccattctttctcttttatgcyttgaaaaatgtgtagcattcatt

SEQ ID NO: 1108 - DNA, 47 bp, Homo Sapiens
  allele 24: 99-2051-360 : polymorphic base A or C
ctgtttggagcacatttggagaamctgcagaggtaggctaggaaagg

SEQ ID NO: 1109 - DNA, 47 bp, Homo Sapiens
  allele 24: 99-20511-221 : polymorphic base C or T
ataaacatccctgcctcgcttttycacctggaagagaggttgtaaga

SEQ ID NO: 1110 - DNA, 47 bp, Homo Sapiens
  allele 24: 99-20514-71 : polymorphic base A or G
agagataaatgttccattactgtrtagtccaataagtataaataagt

SEQ ID NO: 1111 - DNA, 47 bp, Homo Sapiens
  allele 24: 99-20518-456 : polymorphic base A or G
ctctactgtatgaacatacctcartttctttgtatattcccatatgt

SEQ ID NO: 1112 - DNA, 47 bp, Homo Sapiens
  allele 24: 99-2052-376 : polymorphic base G or T
tcctgaaaaaatccattccaaagkgcttttacatgaactaaaaagat

SEQ ID NO: 1113 - DNA, 47 bp, Homo Sapiens
  allele 24: 99-20527-220 : polymorphic base A or T
gctggttcctgcagtcactcaagwttctaaagaaaaatggtgaatta

SEQ ID NO: 1114 - DNA, 47 bp, Homo Sapiens
  allele 24: 99-2053-386 : polymorphic base A or G
aggaaacgatatttatgacttcarggtaagaatggaatgcttgaaca

SEQ ID NO: 1115 - DNA, 47 bp, Homo Sapiens
  allele 24: 99-20531-285 : polymorphic base A or C
tccttatcattacagtttctgtcmatgtctacacatcctgtttctgt

SEQ ID NO: 1116 - DNA, 47 bp, Homo Sapiens
  allele 24: 99-2054-93 : polymorphic base A or G
ttatgagtttttttccctctcagrgtgagccagcttatatttaattt

SEQ ID NO: 1117 - DNA, 47 bp, Homo Sapiens
  allele 24: 99-20542-248 : polymorphic base A or G
acgtccacaacttcgcattcaagraaaatggtttaagataaagagga

SEQ ID NO: 1118 - DNA, 47 bp, Homo Sapiens
  allele 24: 99-20549-141 : polymorphic base A or G
taattacaattatttaacctacarggaaacaaaatttagagggagag

SEQ ID NO: 1119 - DNA, 47 bp, Homo Sapiens
  allele 24: 99-2055-236 : polymorphic base A or G
catcaaaaatgttaagagacactrgagatactggaataaagcagaaa

SEQ ID NO: 1120 - DNA, 47 bp, Homo Sapiens
  allele 24: 99-20552-37 : polymorphic base C or T
cttcccagagcccttatttgatayaggttgagttctgatgagtttcc

SEQ ID NO: 1121 - DNA, 47 bp, Homo Sapiens
  allele 24: 99-2056-474 : polymorphic base C or T
aaattcactataatgcttaacccyggaattagaactggaatcagaat

SEQ ID NO: 1122 - DNA, 47 bp, Homo Sapiens
  allele 24: 99-20561-126 : polymorphic base G or T
ttgccaagaagagtgtaacagaakatcatgagcgaggatacttagga

SEQ ID NO: 1123 - DNA, 47 bp, Homo Sapiens
  allele 24: 99-20565-190 : polymorphic base C or T
ctttaaaaaacatttgagaaagcyagaaagcagaggggaggaagctc

SEQ ID NO: 1124 - DNA, 47 bp, Homo Sapiens
  allele 24: 99-20566-376 : polymorphic base A or G
tcagtactattctttgctattatrcccttgccaaagcattaatgcta

SEQ ID NO: 1125 - DNA, 47 bp, Homo Sapiens
  allele 24: 99-20567-268 : polymorphic base C or T
ttataaggtggtaaggtagtgtaygtaatgcacttagttcagtgtct

SEQ ID NO: 1126 - DNA, 47 bp, Homo Sapiens; identical to SEQ ID NO: 947
  allele 24: 99-20568-284 : polymorphic base A or C

SEQ ID NO: 1127 - DNA, 47 bp, Homo Sapiens
  allele 24: 99-2058-168 : polymorphic base G or T
tccttatgcagatcaattaggagkttactaggctatcccatctattt

SEQ ID NO: 1128 - DNA, 47 bp, Homo Sapiens
  allele 24: 99-20581-125 : polymorphic base A or T
taaaggtgaaataaagaaagaaawtcaaatcattgaaaaagagagtg

SEQ ID NO: 1129 - DNA, 47 bp, Homo Sapiens; identical to SEQ ID NO: 948
  allele 24: 99-20594-103 : polymorphic base G or C

SEQ ID NO: 1130 - DNA, 47 bp, Homo Sapiens
  allele 24: 99-2060-322 : polymorphic base A or T
ccaaagtgttaatggatacttgtwaaccactgacatagtctggggca

SEQ ID NO: 1131 - DNA, 47 bp, Homo Sapiens
  allele 24: 99-2061-257 : polymorphic base A or C
ttccaaaatcaaaccctacaaggmccccccaagtatagcagcactaa

SEQ ID NO: 1132 - DNA, 47 bp, Homo Sapiens
  allele 24: 99-20616-287 : polymorphic base C or T
taatagtaattgactcataggggytgcctgaaaattaacttaaacaa

SEQ ID NO: 1133 - DNA, 47 bp, Homo Sapiens
  allele 24: 99-20623-354 : polymorphic base C or T
ggtcctgtgttcccaaagctgccyattatgaagtctggagttacttt

SEQ ID NO: 1134 - DNA, 47 bp, Homo Sapiens
  allele 24: 99-2063-451 : polymorphic base A or G
gcatgagccatggcacccggcccrgtgtatctgttgatcctggaata

SEQ ID NO: 1135 - DNA, 47 bp, Homo Sapiens
  allele 24: 99-20639-257 : polymorphic base C or T
taggtagatcttttatctctttgyatgcccttcttaaaaaggtgtta

SEQ ID NO: 1136 - DNA, 47 bp, Homo Sapiens
  allele 24: 99-20642-382 : polymorphic base A or G
tcttgtaactgatataatcctagrtcagatgaagtatagtaatcctt

SEQ ID NO: 1137 - DNA, 47 bp, Homo Sapiens
  allele 24: 99-20651-108 : polymorphic base A or G
gcgaattatctgaataaagacctraacaggtagtgcctggcacaggt

SEQ ID NO: 1138 - DNA, 47 bp, Homo Sapiens
  allele 24: 99-20656-171 : polymorphic base C or T
tttcacacatgctagtcccactgyctgataaattcctgccctcattc

SEQ ID NO: 1139 - DNA, 47 bp, Homo Sapiens
  allele 24: 99-20659-289 : polymorphic base C or T
taatatgtaattgaaataattcayctgctgtgaggagaaattttggg

SEQ ID NO: 1140 - DNA, 47 bp, Homo Sapiens
  allele 24: 99-20675-407 : polymorphic base G or C
tcttagtgattttatttatggaasattcatgaaataacataattatg

SEQ ID NO: 1141 - DNA, 47 bp, Homo Sapiens
  allele 24: 99-20677-289 : polymorphic base C or T
tgtgagtgctcttctttgaatgtycacattaattaccctgaacctgg

SEQ ID NO: 1142 - DNA, 47 bp, Homo Sapiens
  allele 24: 99-20683-98 : polymorphic base A or C
tccacatctaaatacttatgcgtmtttatgactaccacactgcccca

SEQ ID NO: 1143 - DNA, 47 bp, Homo Sapiens
  allele 24: 99-20688-310 : polymorphic base A or G
atttataccacaaacataaaagtrttgaagagactgaggaatttagt

SEQ ID NO: 1144 - DNA, 47 bp, Homo Sapiens
  allele 24: 99-20723-206 : polymorphic base C or T
catttttaagccaatgaaccaaayggaatttcaacccatattgttat

SEQ ID NO: 1145 - DNA, 47 bp, Homo Sapiens; identical to SEQ ID NO: 1143
  allele 24: 99-20726-494 : polymorphic base A or G

SEQ ID NO: 1146 - DNA, 47 bp, Homo Sapiens
  allele 24: 99-20732-413 : polymorphic base G or C
gatcactcattaatttcaagatcscacacagttaatttcaatccaac

SEQ ID NO: 1147 - DNA, 47 bp, Homo Sapiens
  allele 24: 99-20738-89 : polymorphic base G or C
cataattatgttatttcatgaatsttccataaataaaatcactaaga

SEQ ID NO: 1148 - DNA, 47 bp, Homo Sapiens
  allele 24: 99-20739-335 : polymorphic base A or G
cagaggacatggtctgtgagaagrctgttgattggatatctaaaggt

SEQ ID NO: 1149 - DNA, 47 bp, Homo Sapiens
  allele 24: 99-2074-273 : polymorphic base A or C
tttctccctactatatcaattgcmttagaatagatttgcatttcaat

SEQ ID NO: 1150 - DNA, 47 bp, Homo Sapiens
  allele 24: 99-20746-369 : polymorphic base A or G
cttttatgtgtgtgtaacagacarttttggatttctatactcggaag

SEQ ID NO: 1151 - DNA, 47 bp, Homo Sapiens
  allele 24: 99-20747-322 : polymorphic base A or G
aacatcacagtgcttagtatacartattcatttattaaaataaaaaa

SEQ ID NO: 1152 - DNA, 47 bp, Homo Sapiens
  allele 24: 99-20766-117 : polymorphic base A or G
ggagcaggctcttagccactaacragcctgaaatgctagtcctttgg

SEQ ID NO: 1153 - DNA, 47 bp, Homo Sapiens
  allele 24: 99-20768-469 : polymorphic base C or T
tcctttgacttttctagtttgaayatgcttcatttcaggagggatgg

SEQ ID NO: 1154 - DNA, 47 bp, Homo Sapiens; identical to SEQ ID NO: 1051
  allele 24: 99-2077-510 : polymorphic base G or C

SEQ ID NO: 1155 - DNA, 47 bp, Homo Sapiens
  allele 24: 99-20771-171 : polymorphic base A or G
caagctatgaaagtagaggtgcarccagtctctcttttcaccaaggg

SEQ ID NO: 1156 - DNA, 47 bp, Homo Sapiens
  allele 24: 99-2078-348 : polymorphic base A or G
gaaacaggtggggcctctctgggraagagagcaattctcccacgcaa

SEQ ID NO: 1157 - DNA, 47 bp, Homo Sapiens
  allele 24: 99-20797-262 : polymorphic base C or T
cctatgcacagcaaggttatagaycttacacaaactagtgatgaagt

SEQ ID NO: 1158 - DNA, 47 bp, Homo Sapiens
  allele 24: 99-20798-87 : polymorphic base C or T
tcaggatgattttatatttgaagytggtcagatttatggcagtcctg

SEQ ID NO: 1159 - DNA, 47 bp, Homo Sapiens
  allele 24: 99-2080-33 : polymorphic base A or G
gagtggatgacccaatggattctrcaccatcttctggcctctgtgcc

SEQ ID NO: 1160 - DNA, 47 bp, Homo Sapiens
  allele 24: 99-20802-358 : polymorphic base C or T
attgtgaatatcatgatcctacaygactttttattgattaaaaagtc

SEQ ID NO: 1161 - DNA, 47 bp, Homo Sapiens
  allele 24: 99-20814-222 : polymorphic base C or T
tttaatgatctagcacaactcttyccaaaaccttaacactgacaacc

SEQ ID NO: 1162 - DNA, 47 bp, Homo Sapiens
  allele 24: 99-2082-284 : polymorphic base A or G
ttctcttactctggggatgtgaaratgtgtctgcttcccctttgcct

SEQ ID NO: 1163 - DNA, 47 bp, Homo Sapiens
  allele 24: 99-20823-49 : polymorphic base C or T
gattaatggatttgatcagtgtcygctcttgtttaaccatggtgctc

SEQ ID NO: 1164 - DNA, 47 bp, Homo Sapiens
  allele 24: 99-20828-131 : polymorphic base C or T
tttggacaaatgaactttccttcyactgtataataccattaaattct

SEQ ID NO: 1165 - DNA, 47 bp, Homo Sapiens
  allele 24: 99-20830-449 : polymorphic base A or G
tgcaattgcttccacacattagartcactattttttaagaaaaaaat

SEQ ID NO: 1166 - DNA, 47 bp, Homo Sapiens
  allele 24: 99-2084-504 : polymorphic base A or G
gtgacaaataattttacgcgtagraaatgtctgccaagaataataac

SEQ ID NO: 1167 - DNA, 47 bp, Homo Sapiens
  allele 24: 99-2085-172 : polymorphic base C or T
acagatgtatccatctgcatgtayattctccccggccacattgcttg

SEQ ID NO: 1168 - DNA, 47 bp, Homo Sapiens
  allele 24: 99-20850-374 : polymorphic base C or T
atttataattttggaattattcaygtttttcttctcatgttggtata

SEQ ID NO: 1169 - DNA, 47 bp, Homo Sapiens
  allele 24: 99-20853-29 : polymorphic base A or G
accatctcatctcactgctacccragacacatatatggcttctgttc

SEQ ID NO: 1170 - DNA, 47 bp, Homo Sapiens
  allele 24: 99-20856-158 : polymorphic base C or T
tttttgctttttttaaacagataygcttttatagattaaaaatgtac

SEQ ID NO: 1171 - DNA, 47 bp, Homo Sapiens
  allele 24: 99-20867-393 : polymorphic base A or G
ttctatcctactccatacttttarcaatcacaagtagcaaccgaata

SEQ ID NO: 1172 - DNA, 47 bp, Homo Sapiens
  allele 24: 99-20872-325 : polymorphic base A or C
gttgagtcaatgtacaaagtaatmcagctctattgagtcatctaaaa

SEQ ID NO: 1173 - DNA, 47 bp, Homo Sapiens
  allele 24: 99-20883-234 : polymorphic base C or T
gaaaaaaaggtcaccagcttgcaytgacactctttcatggtgttttc

SEQ ID NO: 1174 - DNA, 47 bp, Homo Sapiens
  allele 24: 99-20887-420 : polymorphic base C or T
tgtctgagaaaaaagtggattttyaatgtatttatgtgatttgtgtt

SEQ ID NO: 1175 - DNA, 47 bp, Homo Sapiens
  allele 24: 99-2089-84 : polymorphic base A or G
aatacaacacagacagccatgaartctgataaactgcagctaccttt

SEQ ID NO: 1176 - DNA, 47 bp, Homo Sapiens
  allele 24: 99-20895-36 : polymorphic base A or G
tgtatattgcmaatatgtctcccratttacatgtgtccttgattttt

SEQ ID NO: 1177 - DNA, 47 bp, Homo Sapiens
  allele 24: 99-2092-323 : polymorphic base A or C
tcggatccctgaggcagcaaatcmctgtaggggcatcccaggactca

SEQ ID NO: 1178 - DNA, 47 bp, Homo Sapiens
  allele 24: 99-20928-66 : polymorphic base G or C
gcacactgaagggtcctcccttastagtagacaataattagccctag

SEQ ID NO: 1179 - DNA, 47 bp, Homo Sapiens
  allele 24: 99-2093-278 : polymorphic base C or T
ttcactcctcttgctgacattttygggggagtcatgactactcagcc

SEQ ID NO: 1180 - DNA, 47 bp, Homo Sapiens
  allele 24: 99-20938-256 : polymorphic base G or T
agaacagaagtaaggacagagcakaagatgaaaaatgagtacaatac

SEQ ID NO: 1181 - DNA, 47 bp, Homo Sapiens; identical to SEQ ID NO: 1047
  allele 24: 99-2094-129 : polymorphic base A or G

SEQ ID NO: 1182 - DNA, 47 bp, Homo Sapiens
  allele 24: 99-20950-251 : polymorphic base G or C
gagatcttgagcagtcaggagccstggatcctctattctgccattga

SEQ ID NO: 1183 - DNA, 47 bp, Homo Sapiens
  allele 24: 99-2098-102 : polymorphic base G or T
ggcaggctgcctcaacctacattkagaagtacgcctcagagagcctt

SEQ ID NO: 1184 - DNA, 47 bp, Homo Sapiens
  allele 24: 99-21012-277 : polymorphic base A or C
aattagccgggcatggtggcacamgcctgtaatcctagctactgggg

SEQ ID NO: 1185 - DNA, 47 bp, Homo Sapiens
  allele 24: 99-21021-273 : polymorphic base C or T
ctgagactctaaggagggacaaayagagagaggctacactgagtaca

SEQ ID NO: 1186 - DNA, 47 bp, Homo Sapiens
  allele 24: 99-2103-270 : polymorphic base G or C
cttggattcatatgagacagctascagaccttcaatttttctacact

SEQ ID NO: 1187 - DNA, 47 bp, Homo Sapiens
  allele 24: 99-21035-279 : polymorphic base C or T
aggtctggcaggctttctcacagygggaatgttaccgaggagtccac

SEQ ID NO: 1188 - DNA, 47 bp, Homo Sapiens
  allele 24: 99-21064-278 : polymorphic base C or T
cagaagagggtaagaagttttaaytgggtgaattagtttcctgtggt

SEQ ID NO: 1189 - DNA, 47 bp, Homo Sapiens
  allele 24: 99-21070-272 : polymorphic base A or G
tgaacaattactccctttttaacrcagcacattgacatttgtttcaa

SEQ ID NO: 1190 - DNA, 47 bp, Homo Sapiens
  allele 24: 99-21079-169 : polymorphic base G or T
accgattaatttctataggaaaakatatgtacttttccatgaaatga

SEQ ID NO: 1191 - DNA, 47 bp, Homo Sapiens
  allele 24: 99-21084-496 : polymorphic base C or T
ccaggacgttaatacaggaatccytctaaagataacataataaaaca

SEQ ID NO: 1192 - DNA, 47 bp, Homo Sapiens
  allele 24: 99-2109-276 : polymorphic base G or T
ccctctcttagttctgtttttttkttgttttgatttgttttgttttg

SEQ ID NO: 1193 - DNA, 47 bp, Homo Sapiens
  allele 24: 99-211-291 : polymorphic base A or G
ctggttatatcagactgaccttcrtgttttcaacaggtcaatgcctt

SEQ ID NO: 1194 - DNA, 47 bp, Homo Sapiens
  allele 24: 99-21141-314 : polymorphic base A or G
agaaaaaagaaatgaattaaataragcaacttcagtgtaaaaaactt

SEQ ID NO: 1195 - DNA, 47 bp, Homo Sapiens
  allele 24: 99-21148-269 : polymorphic base A or G
gttgtctttctgtcgccttccctrggatgggccccatgaggatgaac

SEQ ID NO: 1196 - DNA, 47 bp, Homo Sapiens
  allele 24: 99-21149-129 : polymorphic base A or G
ggcacttagtggatgggctcagcrtggctaaatgctctataattcct

SEQ ID NO: 1197 - DNA, 47 bp, Homo Sapiens
  allele 24: 99-21167-159 : polymorphic base C or T
gtaaagccttaaatcaatgtttgytgaactgaagacttggtgaaaaa

SEQ ID NO: 1198 - DNA, 47 bp, Homo Sapiens
  allele 24: 99-2117-107 : polymorphic base C or T
ttttttctttgactcagtgattgytcaagagtgtgttagtttccaca

SEQ ID NO: 1199 - DNA, 47 bp, Homo Sapiens
  allele 24: 99-21221-96 : polymorphic base A or T
ggcatccaagacactcaagggagwtactaatggcattttggttagga

SEQ ID NO: 1200 - DNA, 47 bp, Homo Sapiens
  allele 24: 99-2126-79 : polymorphic base A or T
gaaaatgtcactacagatatagawgttataaaaaaatacaaatactg

SEQ ID NO: 1201 - DNA, 47 bp, Homo Sapiens
  allele 24: 99-21370-87 : polymorphic base C or T
ccctccctcccgcaaactcacagyctcctcatcactctctkctcaga

SEQ ID NO: 1202 - DNA, 47 bp, Homo Sapiens
  allele 24: 99-2170-188 : polymorphic base G or C
tttataatcccaagattaatactsactgcagttttgcaattattcac

SEQ ID NO: 1203 - DNA, 47 bp, Homo Sapiens
  allele 24: 99-2172-314 : polymorphic base A or G
aaattttgatatatcccaattaarcttggagtttatatgccataaga

SEQ ID NO: 1204 - DNA, 47 bp, Homo Sapiens
  allele 24: 99-2173-289 : polymorphic base C or T
accccagatatcatggtcactttytggttttctccctctctccctct

SEQ ID NO: 1205 - DNA, 47 bp, Homo Sapiens
  allele 24: 99-2179-303 : polymorphic base G or T
acaacatacaggtgtaacttttckgaaagcaaataaacaccctaaac

SEQ ID NO: 1206 - DNA, 47 bp, Homo Sapiens
  allele 24: 99-2193-225 : polymorphic base A or G
aaaaagacattcatgaattataartcatctgaaaggttccgtaggag

SEQ ID NO: 1207 - DNA, 47 bp, Homo Sapiens; identical to SEQ ID NO: 1168
  allele 24: 99-22011-342 : polymorphic base C or T

SEQ ID NO: 1208 - DNA, 47 bp, Homo Sapiens
  allele 24: 99-22015-219 : polymorphic base A or G
ctattatcatgttgtaggtctcartgaataactcatctaaatactga

SEQ ID NO: 1209 - DNA, 47 bp, Homo Sapiens
  allele 24: 99-22022-145 : polymorphic base A or G
cccaaaatttctcctcacagcagrtgaattatttcaattacatatta

SEQ ID NO: 1210 - DNA, 47 bp, Homo Sapiens
  allele 24: 99-22027-410 : polymorphic base G or C
cattatgatggatattgtagatasaacaccacttagaaactagaaca

SEQ ID NO: 1211 - DNA, 47 bp, Homo Sapiens
  allele 24: 99-22036-314 : polymorphic base A or T
caaaaagtttgaaaataaaaggawaagcaaaaacatatcattaaaag

SEQ ID NO: 1212 - DNA, 47 bp, Homo Sapiens
  allele 24: 99-22038-381 : polymorphic base G or C
cagcctgataccaccagacagagsccaggtaggtttgatgaatgtca

SEQ ID NO: 1213 - DNA, 47 bp, Homo Sapiens
  allele 24: 99-22044-431 : polymorphic base A or G
cttaactttatattttagaaatcrcatttaatgtgacccagttaaac

SEQ ID NO: 1214 - DNA, 47 bp, Homo Sapiens
  allele 24: 99-22048-259 : polymorphic base A or G
atgaaagtttcttccagctagctraacgcagtgtacacttcatctct

SEQ ID NO: 1215 - DNA, 47 bp, Homo Sapiens
  allele 24: 99-22051-261 : polymorphic base C or T
atttagtgactgtttaattttatygatcctcatatttttctactgag

SEQ ID NO: 1216 - DNA, 47 bp, Homo Sapiens; identical to SEQ ID NO: 1137
  allele 24: 99-22066-139 : polymorphic base A or G

SEQ ID NO: 1217 - DNA, 47 bp, Homo Sapiens
  allele 24: 99-22072-80 : polymorphic base C or T
ttatataaatagctacaaagagtytgacatatagttggtgcttagta

SEQ ID NO: 1218 - DNA, 47 bp, Homo Sapiens
  allele 24: 99-22073-381 : polymorphic base G or C
catttggtaatgcatctggaaggsgtgatttgtcacgtaattataag

SEQ ID NO: 1219 - DNA, 47 bp, Homo Sapiens
  allele 24: 99-22078-350 : polymorphic base A or G
atcagggaacatatttgtagttcrtaaagagaataggaataatttga

SEQ ID NO: 1220 - DNA, 47 bp, Homo Sapiens
  allele 24: 99-22087-150 : polymorphic base C or T
cacagtccagatttctcacagtaycttttgttcattttactgctcct

SEQ ID NO: 1221 - DNA, 47 bp, Homo Sapiens
  allele 24: 99-2209-111 : polymorphic base A or G
gaaggaaggaaagccaagagttgrtggacaggctgtgaatgcagagt

SEQ ID NO: 1222 - DNA, 47 bp, Homo Sapiens
  allele 24: 99-22091-289 : polymorphic base G or T
aactaacagaacacataaaacttktccatttcatgtgtttaatttta

SEQ ID NO: 1223 - DNA, 47 bp, Homo Sapiens
  allele 24: 99-22096-276 : polymorphic base C or T
atttttattctgaagaaaaaacaygaatgtagacctttactctgcct

SEQ ID NO: 1224 - DNA, 47 bp, Homo Sapiens
  allele 24: 99-22100-265 : polymorphic base C or T
tctaactaagatgactaaagtaayggcaagtaccagcaagacttaaa

SEQ ID NO: 1225 - DNA, 47 bp, Homo Sapiens
  allele 24: 99-22102-238 : polymorphic base C or T
aagtgattcctataaagtcaagaygaggttgctaaggtgggagagaa

SEQ ID NO: 1226 - DNA, 47 bp, Homo Sapiens
  allele 24: 99-22122-54 : polymorphic base A or G
gaggaatcctcacaagacaggctragagttagcgtaatactagcagc

SEQ ID NO: 1227 - DNA, 47 bp, Homo Sapiens
  allele 24: 99-22125-126 : polymorphic base C or T
aaatgcagattatcaaatcctacycctgagactcctgccttactctc

SEQ ID NO: 1228 - DNA, 47 bp, Homo Sapiens
  allele 24: 99-2214-148 : polymorphic base A or C
atgagaaggaaaaaaataaaagamcactatttatgatggtggcaaga

SEQ ID NO: 1229 - DNA, 47 bp, Homo Sapiens
  allele 24: 99-22147-359 : polymorphic base C or T
ctctgtcttttcccagattctctytttagttcaggcatatgttcagg

SEQ ID NO: 1230 - DNA, 47 bp, Homo Sapiens
  allele 24: 99-22160-331 : polymorphic base A or G
tcaagttcatatatcttctccacrctgattgcttccatatttacatt

SEQ ID NO: 1231 - DNA, 47 bp, Homo Sapiens
  allele 24: 99-22167-79 : polymorphic base C or T
gggtaaaatttagatctctttccytgaataaattaggcttcatcttg

SEQ ID NO: 1232 - DNA, 47 bp, Homo Sapiens
  allele 24: 99-22172-304 : polymorphic base A or T
ctaataaatagtggagaaaaaaawttctaagaatctagagagggaaa

SEQ ID NO: 1233 - DNA, 47 bp, Homo Sapiens
  allele 24: 99-2218-219 : polymorphic base A or G
aaagagctctttataaatcattcrgaaaaatagcactctcaatggaa

SEQ ID NO: 1234 - DNA, 47 bp, Homo Sapiens
  allele 24: 99-22189-248 : polymorphic base C or T
agggatttattcttttacatgatytactaatgttttaagccgagcaa

SEQ ID NO: 1235 - DNA, 47 bp, Homo Sapiens
  allele 24: 99-2219-245 : polymorphic base C or T
tgcctaatattaatatagagactycagctttcttatgattagtgagt

SEQ ID NO: 1236 - DNA, 47 bp, Homo Sapiens
  allele 24: 99-22191-339 : polymorphic base C or T
caggcaaggctcagccattcctayccatcctccccacacttgcatac

SEQ ID NO: 1237 - DNA, 47 bp, Homo Sapiens
  allele 24: 99-22192-383 : polymorphic base C or T
atggaagacaaaacaaacatacayaaagttaaattaaaatatttaag

SEQ ID NO: 1238 - DNA, 47 bp, Homo Sapiens
  allele 24: 99-222-109 : polymorphic base C or T
caggtgaggagtgctggattggcyacgatatgaatttcttcagcagt

SEQ ID NO: 1239 - DNA, 47 bp, Homo Sapiens
  allele 24: 99-2220-300 : polymorphic base A or G
ggcttcattggtgaattctacaargcaacttaggaagaaataatact

SEQ ID NO: 1240 - DNA, 47 bp, Homo Sapiens
  allele 24: 99-22209-304 : polymorphic base A or C
tggtgtgtttcaatttctgagggmaacaaatattcagaattgacaat

SEQ ID NO: 1241 - DNA, 47 bp, Homo Sapiens
  allele 24: 99-22215-391 : polymorphic base A or G
aattgtatgtattcatggggtacratttgatattttcatacatatat

SEQ ID NO: 1242 - DNA, 47 bp, Homo Sapiens
  allele 24: 99-22217-423 : polymorphic base G or C
agatgatgtaattgaaaaacagasagtttctgtaacttggcaaagtc

SEQ ID NO: 1243 - DNA, 47 bp, Homo Sapiens
  allele 24: 99-2222-459 : polymorphic base C or T
gctggcaacctcccctacctcatyttctgtctttgttcccctcactc

SEQ ID NO: 1244 - DNA, 47 bp, Homo Sapiens
  allele 24: 99-22227-275 : polymorphic base A or T
agagaggaagagaaacctctaggwtcgttcagtaaaacactgtgagg

SEQ ID NO: 1245 - DNA, 47 bp, Homo Sapiens
  allele 24: 99-22255-384 : polymorphic base A or G
ccagcaccacaaacacacccgccrgccaggcctctcattaccacctg

SEQ ID NO: 1246 - DNA, 47 bp, Homo Sapiens
  allele 24: 99-22262-331 : polymorphic base C or T
tggcacaaaaagacaggatatgcytgtaactcagaaatgtggaaaaa

SEQ ID NO: 1247 - DNA, 47 bp, Homo Sapiens
  allele 24: 99-22265-294 : polymorphic base A or C
tttcttaaaagaaagacactgaamactacttctaccttctttttagt

SEQ ID NO: 1248 - DNA, 47 bp, Homo Sapiens
  allele 24: 99-22266-474 : polymorphic base C or T
agtaaaatcattcaccattctcayggtgggactttgtctagtaaata

SEQ ID NO: 1249 - DNA, 47 bp, Homo Sapiens
  allele 24: 99-2228-301 : polymorphic base A or G
ccctgcttatccctgtaaggtggrgacccatatgggcaaggccagac

SEQ ID NO: 1250 - DNA, 47 bp, Homo Sapiens
  allele 24: 99-2229-240 : polymorphic base G or T
tcgtcatcgtggcctgggctacakactacctgttccagtccttccag

SEQ ID NO: 1251 - DNA, 47 bp, Homo Sapiens
  allele 24: 99-22333-237 : polymorphic base C or T
cacttgaggccatagccaactgtygggggaaacttaagaaaaaaccc

SEQ ID NO: 1252 - DNA, 47 bp, Homo Sapiens
  allele 24: 99-22336-316 : polymorphic base C or T
gtcttagctcatgaacttccttgygcctgtaacacatcccagagtgt

SEQ ID NO: 1253 - DNA, 47 bp, Homo Sapiens
  allele 24: 99-22337-199 : polymorphic base A or C
ttgatggtttaacattgattttamgattataagccctggtgctagac

SEQ ID NO: 1254 - DNA, 47 bp, Homo Sapiens
  allele 24: 99-2235-499 : polymorphic base G or C
agaacttgtacatgaatgttcacsgtagcattattccatgataacca

SEQ ID NO: 1255 - DNA, 47 bp, Homo Sapiens
  allele 24: 99-22356-370 : polymorphic base A or C
aagcagtcagtactaatttcagamgtgctgccttgctattgcgtata

SEQ ID NO: 1256 - DNA, 47 bp, Homo Sapiens
  allele 24: 99-22357-186 : polymorphic base C or T
tcttttgctgtttgccccccttgytctgttttctgctcctcctgccc

SEQ ID NO: 1257 - DNA, 47 bp, Homo Sapiens
  allele 24: 99-2240-281 : polymorphic base C or T
gcaatcttaataactttttatttyagtaattcgaatcttttttttct

SEQ ID NO: 1258 - DNA, 47 bp, Homo Sapiens
  allele 24: 99-22409-141 : polymorphic base C or T
aaggcaggagagattccagaatgyatgggtcagggaggaggagccag

SEQ ID NO: 1259 - DNA, 47 bp, Homo Sapiens
  allele 24: 99-2242-206 : polymorphic base C or T
gtgttttcttttagtcaaattatyttatattttacttttttcttaag

SEQ ID NO: 1260 - DNA, 47 bp, Homo Sapiens
  allele 24: 99-2244-83 : polymorphic base A or G
taattgtagatactaagaccattrtgcttaaaccatgtaggtactga

SEQ ID NO: 1261 - DNA, 47 bp, Homo Sapiens
  allele 24: 99-22442-147 : polymorphic base G or T
acgattgtttaggcaccgaagagkcctgaactgggccagcagtcaga

SEQ ID NO: 1262 - DNA, 47 bp, Homo Sapiens
  allele 24: 99-22449-216 : polymorphic base G or C
aaaatggaataatttgaacttttstaaattagtaggagaaaaaaatt

SEQ ID NO: 1263 - DNA, 47 bp, Homo Sapiens
  allele 24: 99-22453-370 : polymorphic base A or T
ataatggtacttacctaagaagtwtattgtgatgagtaaacactata

SEQ ID NO: 1264 - DNA, 47 bp, Homo Sapiens
  allele 24: 99-22456-55 : polymorphic base A or C
agggacaacctacagcaagaggamttcaggacagctgcaggggagag

SEQ ID NO: 1265 - DNA, 47 bp, Homo Sapiens
  allele 24: 99-2246-340 : polymorphic base A or G
atttatatgttaaatgcagagaaraagaaaaataagttttgcagtaa

SEQ ID NO: 1266 - DNA, 47 bp, Homo Sapiens
  allele 24: 99-2248-76 : polymorphic base C or T
gacagagagggaaggtaatcttcycctgaagtctgcccatcccctgg

SEQ ID NO: 1267 - DNA, 47 bp, Homo Sapiens
  allele 24: 99-22490-246 : polymorphic base A or G
taatccccatctctctctgctgcrtgaccctgagttatttgggaccc

SEQ ID NO: 1268 - DNA, 47 bp, Homo Sapiens; identical to SEQ ID NO: 1261
  allele 24: 99-22491-79 : polymorphic base G or T

SEQ ID NO: 1269 - DNA, 47 bp, Homo Sapiens
  allele 24: 99-2250-236 : polymorphic base C or T
atgtatccaaaacagaattaacayactttgggttttttatttttatt

SEQ ID NO: 1270 - DNA, 47 bp, Homo Sapiens
  allele 24: 99-22503-146 : polymorphic base C or T
caattgactgttggaaactatgcyatgtttattcttcccatttgaga

SEQ ID NO: 1271 - DNA, 47 bp, Homo Sapiens
  allele 24: 99-22506-395 : polymorphic base C or T
tcagtgaccacttctccatcaacytcagaatcttccaaaaatbttcc

SEQ ID NO: 1272 - DNA, 47 bp, Homo Sapiens
  allele 24: 99-22513-90 : polymorphic base A or G
tccaccacttgcttttggacatcrgggaaagaagctggcctaaatac

SEQ ID NO: 1273 - DNA, 47 bp, Homo Sapiens
  allele 24: 99-22520-413 : polymorphic base G or C
tcagagacccttgactatcgtaasaattttaagtagttaaaccaaac

SEQ ID NO: 1274 - DNA, 47 bp, Homo Sapiens
  allele 24: 99-22546-125 : polymorphic base C or T
agagatatgattgtagattctggytgtatgtaataataatacctctt

SEQ ID NO: 1275 - DNA, 47 bp, Homo Sapiens
  allele 24: 99-22565-114 : polymorphic base A or G
ccaaggaagtcacaccggatatgrcaatgggttgtgacaaaatctgt

SEQ ID NO: 1276 - DNA, 47 bp, Homo Sapiens
  allele 24: 99-22571-136 : polymorphic base C or T
atgcctgttacattcacctaacayagtgactcacttcacagatgctc

SEQ ID NO: 1277 - DNA, 47 bp, Homo Sapiens
  allele 24: 99-22573-321 : polymorphic base A or G
aaagcgtaagttttgtgagacacragcagcactttccaaagtgggga

SEQ ID NO: 1278 - DNA, 47 bp, Homo Sapiens
  allele 24: 99-22578-78 : polymorphic base C or T
gtgattttccccaaggtaccatgytcattggtttccacaggacaggc

SEQ ID NO: 1279 - DNA, 47 bp, Homo Sapiens
  allele 24: 99-22580-72 : polymorphic base A or T
aaacgggattctagtaaaggctcwtggtcttataatccaatatttat

SEQ ID NO: 1280 - DNA, 47 bp, Homo Sapiens
  allele 24: 99-22585-462 : polymorphic base G or C
gggacttgccactggaatttttcsttaaaatgttaaaacagtattta

SEQ ID NO: 1281 - DNA, 47 bp, Homo Sapiens
  allele 24: 99-22586-39 : polymorphic base A or G
cagcaaaacagggtgatgggatgraagcatgatgggctgctactttg

SEQ ID NO: 1282 - DNA, 47 bp, Homo Sapiens
  allele 24: 99-22604-208 : polymorphic base G or T
ccagtaaaaattcttctctttttktggagcatgtggctcaggcgccc

SEQ ID NO: 1283 - DNA, 47 bp, Homo Sapiens
  allele 24: 99-22610-343 : polymorphic base A or G
cagactattttccttcttaactcrctttttacagcagtgtttctcct

SEQ ID NO: 1284 - DNA, 47 bp, Homo Sapiens
  allele 24: 99-22615-392 : polymorphic base C or T
gatacctctcctttccactgtctycatgtttctttcagcttgggtct

SEQ ID NO: 1285 - DNA, 47 bp, Homo Sapiens
  allele 24: 99-22617-378 : polymorphic base C or T
acatctctttttctcacatctctygctttgtttctacctccattcct

SEQ ID NO: 1286 - DNA, 47 bp, Homo Sapiens
  allele 24: 99-22620-404 : polymorphic base C or T
ggaattcttactatcccgaaaacyccaggtgtggtgtgtcctcctct

SEQ ID NO: 1287 - DNA, 47 bp, Homo Sapiens
  allele 24: 99-22628-292 : polymorphic base A or G
tatttgattacagggcctggaacrtagtaagtgctcaataaatgttt

SEQ ID NO: 1288 - DNA, 47 bp, Homo Sapiens
  allele 24: 99-22629-124 : polymorphic base C or T
tttggaaatagattattatgtaayctctcccacaccgagataattgg

SEQ ID NO: 1289 - DNA, 47 bp, Homo Sapiens
  allele 24: 99-22632-237 : polymorphic base G or C
acctccaggcagcaggtggatagsagagcccacgtgggggacggttg

SEQ ID NO: 1290 - DNA, 47 bp, Homo Sapiens
  allele 24: 99-22646-233 : polymorphic base A or G
ttcattttgattatatctttgtargcatcagattctagtgcacagga

SEQ ID NO: 1291 - DNA, 47 bp, Homo Sapiens
  allele 24: 99-22648-57 : polymorphic base C or T
gtatgcagtcattaaaaacttaayaagggaagatacctttgatccag

SEQ ID NO: 1292 - DNA, 47 bp, Homo Sapiens
  allele 24: 99-22650-64 : polymorphic base A or C
acattttattttcaacagatgagmgccctggaattccatggaagaca

SEQ ID NO: 1293 - DNA, 47 bp, Homo Sapiens
  allele 24: 99-22652-343 : polymorphic base A or G
taggagtgatggaactttttttgrgaatgggcagaatgtaacagaaa

SEQ ID NO: 1294 - DNA, 47 bp, Homo Sapiens
  allele 24: 99-22655-319 : polymorphic base A or T
cctagggtctcaacccctaatccwcctgtcagagaagaaactttgaa

SEQ ID NO: 1295 - DNA, 47 bp, Homo Sapiens
  allele 24: 99-22660-386 : polymorphic base A or G
agtgaacatagctgttccatcttrcatagaatattgtaaccaatgtc

SEQ ID NO: 1296 - DNA, 47 bp, Homo Sapiens
  allele 24: 99-22662-268 : polymorphic base A or G
tatgaccatcataaaaccaacagratggggaagaaaaaaaccacctt

SEQ ID NO: 1297 - DNA, 47 bp, Homo Sapiens
  allele 24: 99-22666-164 : polymorphic base C or T
catctaagacagaattataaagtyctaacacttgaaaatgtaccttt

SEQ ID NO: 1298 - DNA, 47 bp, Homo Sapiens
  allele 24: 99-22668-232 : polymorphic base G or T
taataggtctttactccacaaaakgtttctgtggtggaaaatatatg

SEQ ID NO: 1299 - DNA, 47 bp, Homo Sapiens
  allele 24: 99-22674-31 : polymorphic base C or T
ccgttaattctcctgtgaatcatyttatggcttgaagactccctatg

SEQ ID NO: 1300 - DNA, 47 bp, Homo Sapiens
  allele 24: 99-22675-187 : polymorphic base A or G
accattctctagtctctgagacarggcaaaaagtagaggcaaaataa

SEQ ID NO: 1301 - DNA, 47 bp, Homo Sapiens
  allele 24: 99-22680-130 : polymorphic base C or T
gcttcctgagggctcttctcttcycctcactcacctttatttgtttt

SEQ ID NO: 1302 - DNA, 47 bp, Homo Sapiens
  allele 24: 99-22683-107 : polymorphic base A or G
gagcccaagagttcgaggcagcartaagccaagatcatgccactgca

SEQ ID NO: 1303 - DNA, 47 bp, Homo Sapiens
  allele 24: 99-2269-179 : polymorphic base A or G
aaaataaagaaattcctagagacrtacagcctatcaagatcaaacca

SEQ ID NO: 1304 - DNA, 47 bp, Homo Sapiens
  allele 24: 99-22700-358 : polymorphic base A or G
atgagctcacctactccccagacrctgctaaatgagggagagaagta

SEQ ID NO: 1305 - DNA, 47 bp, Homo Sapiens
  allele 24: 99-22701-307 : polymorphic base C or T
tattttgttgtacgtgtgggacaygtgcctcatctacttacatttga

SEQ ID NO: 1306 - DNA, 47 bp, Homo Sapiens
  allele 24: 99-2271-403 : polymorphic base A or G
aggcatttatttcatatttattarccttgattttcttatcttcaagt

SEQ ID NO: 1307 - DNA, 47 bp, Homo Sapiens
  allele 24: 99-22712-242 : polymorphic base A or G
tctgtaatgatacgttcatatacrtgtctcctcctcaagtttgaaag

SEQ ID NO: 1308 - DNA, 47 bp, Homo Sapiens
  allele 24: 99-22718-94 : polymorphic base A or T
aaacatctatattcattttgaaawtatctatacacaagctggaggcg

SEQ ID NO: 1309 - DNA, 47 bp, Homo Sapiens
  allele 24: 99-2272-409 : polymorphic base G or T
aaaagcactgcaattattttggakactgtgaaatattgcaagtttta

SEQ ID NO: 1310 - DNA, 47 bp, Homo Sapiens
  allele 24: 99-22728-207 : polymorphic base A or G
actgtactggtttcctgtactcarttggtagtactacacacattaca

SEQ ID NO: 1311 - DNA, 47 bp, Homo Sapiens
  allele 24: 99-2273-528 : polymorphic base C or T
acttgaagataagaaaatcaaggytaataaatatgaaataaatgcct

SEQ ID NO: 1312 - DNA, 47 bp, Homo Sapiens
  allele 24: 99-22733-281 : polymorphic base G or C
tgtattttatttaaaaagcagctsactcatttgatcttaaccctttg

SEQ ID NO: 1313 - DNA, 47 bp, Homo Sapiens
  allele 24: 99-22741-180 : polymorphic base A or G
agcttattccaaagtttgggggtrcccaataatgcctctatactgtg

SEQ ID NO: 1314 - DNA, 47 bp, Homo Sapiens
  allele 24: 99-2275-466 : polymorphic base C or T
ttgatgatagcattaaatactccyaaaaactgtgaatagggatacta

SEQ ID NO: 1315 - DNA, 47 bp, Homo Sapiens
  allele 24: 99-2276-331 : polymorphic base C or T
tccctcattattcctttccattgycatggtggaagttcccctttcag

SEQ ID NO: 1316 - DNA, 47 bp, Homo Sapiens
  allele 24: 99-22771-150 : polymorphic base A or G
gcaaggcattcagtgtttgttgartgaatgaaaagtaaacgagggaa

SEQ ID NO: 1317 - DNA, 47 bp, Homo Sapiens
  allele 24: 99-22775-365 : polymorphic base C or T
ccatgcattccaaaatctccacayaccatatgctgagtggtctgtgg

SEQ ID NO: 1318 - DNA, 47 bp, Homo Sapiens
  allele 24: 99-2278-276 : polymorphic base A or G
gaaaaaaatgggaacatcttcacrgcctgtgcatctccaacaagatt

SEQ ID NO: 1319 - DNA, 47 bp, Homo Sapiens
  allele 24: 99-22785-431 : polymorphic base A or T
tctgctataataacttattatccwtgttatcttgttatttaattttt

SEQ ID NO: 1320 - DNA, 47 bp, Homo Sapiens
  allele 24: 99-22843-342 : polymorphic base G or T
tgcccgcttgggtgccgatggagktggtggtgttagcgatgagaagg

SEQ ID NO: 1321 - DNA, 47 bp, Homo Sapiens
  allele 24: 99-22844-211 : polymorphic base A or G
acatgagagaatcacttgaacccrggaggcagaggttgcagtgagct

SEQ ID NO: 1322 - DNA, 47 bp, Homo Sapiens
  allele 24: 99-22857-88 : polymorphic base C or T
taccttttcctcacatttcaaaayggtcaagtttaaagataccaact

SEQ ID NO: 1323 - DNA, 47 bp, Homo Sapiens
  allele 24: 99-22868-425 : polymorphic base A or C
tgtatggtgttgtccccaataagmagagcatatgggtccaggaacca

SEQ ID NO: 1324 - DNA, 47 bp, Homo Sapiens
  allele 24: 99-22872-431 : polymorphic base C or T
atttttttatcctatcgcaggacyatgttaactttcttcccactaat

SEQ ID NO: 1325 - DNA, 47 bp, Homo Sapiens
  allele 24: 99-2288-144 : polymorphic base C or T
tcttattagagggaaggtattatyttctacattgcctaaactctaaa

SEQ ID NO: 1326 - DNA, 47 bp, Homo Sapiens
  allele 24: 99-22917-145 : polymorphic base G or T
ttttgttttgctggttatttttakcaacaataaatcaaactaagtgc

SEQ ID NO: 1327 - DNA, 47 bp, Homo Sapiens
  allele 24: 99-22937-395 : polymorphic base C or T
aaaaaagaaggggaagagtgaaayggaaggagagaatggtgtaagta

SEQ ID NO: 1328 - DNA, 47 bp, Homo Sapiens
  allele 24: 99-22948-262 : polymorphic base C or T
ctgactacctttcttccctttttyctttatcagcaacacccttcatt

SEQ ID NO: 1329 - DNA, 47 bp, Homo Sapiens
  allele 24: 99-22954-306 : polymorphic base A or C
actatatttgaatgagcaatgtamcagtacttttcttattaatttta

SEQ ID NO: 1330 - DNA, 47 bp, Homo Sapiens
  allele 24: 99-22957-409 : polymorphic base A or G
gcttactacttacctcattaatgrgcaccattagtcttacagtagac

SEQ ID NO: 1331 - DNA, 47 bp, Homo Sapiens
  allele 24: 99-22959-239 : polymorphic base A or G
ctggtgttttgtctgcttgttctrtaagcttctaaaataagtgggtt

SEQ ID NO: 1332 - DNA, 47 bp, Homo Sapiens
  allele 24: 99-22964-82 : polymorphic base C or T
ctgggaccagggccagcatacccyggagtatgttcctggagccaggg

SEQ ID NO: 1333 - DNA, 47 bp, Homo Sapiens
  allele 24: 99-22975-126 : polymorphic base C or T
aacactacaaactgggtagaatayatgaagtgcttggcttcagaccc

SEQ ID NO: 1334 - DNA, 47 bp, Homo Sapiens
  allele 24: 99-23014-300 : polymorphic base A or G
aacatcctgtgggagatgaaagtrtgtgtgctgttttgaaattaaaa

SEQ ID NO: 1335 - DNA, 47 bp, Homo Sapiens
  allele 24: 99-23018-166 : polymorphic base A or G
ataattcctttctcctttgggggrgattgtcaatgtatttttttcaa

SEQ ID NO: 1336 - DNA, 47 bp, Homo Sapiens
  allele 24: 99-23020-187 : polymorphic base G or T
gaaaagaaaaggtgaggggagagkaagcttaaaggagggttgaccta

SEQ ID NO: 1337 - DNA, 47 bp, Homo Sapiens
  allele 24: 99-23083-59 : polymorphic base C or T
acttcctttaaccagtggaatgtyagcggatataatgcaagtagaga

SEQ ID NO: 1338 - DNA, 47 bp, Homo Sapiens
  allele 24: 99-23100-367 : polymorphic base A or G
ccactgagccgaggggcccactcrgcatgtaggctcaggctcaatgg

SEQ ID NO: 1339 - DNA, 47 bp, Homo Sapiens
  allele 24: 99-23115-404 : polymorphic base G or C
cctcactgagccagaaatccctasctctgtcagccagttcctctcct

SEQ ID NO: 1340 - DNA, 47 bp, Homo Sapiens
  allele 24: 99-23118-402 : polymorphic base A or G
gaatcaggaaaatgtgatctatarccaagagtggggagaaaaccact

SEQ ID NO: 1341 - DNA, 47 bp, Homo Sapiens
  allele 24: 99-2312-358 : polymorphic base C or T
ttgaagagagagatggaaaaaaaygtaggccttctgggtaaatggcc

SEQ ID NO: 1342 - DNA, 47 bp, Homo Sapiens
  allele 24: 99-23123-250 : polymorphic base A or G
tttcccgatacatatgagactttrtaattatgaaatccatcgccaga

SEQ ID NO: 1343 - DNA, 47 bp, Homo Sapiens
  allele 24: 99-23127-314 : polymorphic base G or C
tgagcaacagtaagagggcttggsatgtcatgtatctgcaggaaaat

SEQ ID NO: 1344 - DNA, 47 bp, Homo Sapiens
  allele 24: 99-23132-192 : polymorphic base A or G
gtctctcagggctgaatccagccracaaaagaacttcttacctagtt

SEQ ID NO: 1345 - DNA, 47 bp, Homo Sapiens
  allele 24: 99-23134-89 : polymorphic base A or G
gacggagcaagagggagcccagcrgtcacagtgtgtcattttagcag

SEQ ID NO: 1346 - DNA, 47 bp, Homo Sapiens
  allele 24: 99-2315-213 : polymorphic base A or G
agatggattctacccacaggcaaragaaaaccttattttaaaaataa

SEQ ID NO: 1347 - DNA, 47 bp, Homo Sapiens
  allele 24: 99-23150-262 : polymorphic base A or C
aagggggattccctgagagcttgmgctctcatcctccctagaagagt

SEQ ID NO: 1348 - DNA, 47 bp, Homo Sapiens
  allele 24: 99-2320-292 : polymorphic base C or T
actctcattcactaaacttcaacygtttttataaatttaatgaattt

SEQ ID NO: 1349 - DNA, 47 bp, Homo Sapiens
  allele 24: 99-23201-345 : polymorphic base C or T
tcacaccaccactgagcaaccctytccaggactgccacctatgcata

SEQ ID NO: 1350 - DNA, 47 bp, Homo Sapiens
  allele 24: 99-23202-185 : polymorphic base A or C
gattctcttattttactttctgamagaaggctgttttgttttttgcc

SEQ ID NO: 1351 - DNA, 47 bp, Homo Sapiens
  allele 24: 99-23204-262 : polymorphic base C or T
gtaattcccaaataatttttaagygctggttatatgtatgaaaacca

SEQ ID NO: 1352 - DNA, 47 bp, Homo Sapiens
  allele 24: 99-23207-281 : polymorphic base C or T
ggactcagcacagagcttttgcaygcatgtccaactgcaacaagctt

SEQ ID NO: 1353 - DNA, 47 bp, Homo Sapiens
  allele 24: 99-2321-82 : polymorphic base C or T
taaagcttactgagtgtccactcyggatacctactcaaatatttcct

SEQ ID NO: 1354 - DNA, 47 bp, Homo Sapiens
  allele 24: 99-23228-176 : polymorphic base G or C
ctcagaaaaagtaacaggcaacastgtgtttcaaattttcgattagt

SEQ ID NO: 1355 - DNA, 47 bp, Homo Sapiens
  allele 24: 99-2324-338 : polymorphic base A or C
agatagaagacaaaatcgcaggamaagaaatccctcaacagtaaaaa

SEQ ID NO: 1356 - DNA, 47 bp, Homo Sapiens
  allele 24: 99-23266-146 : polymorphic base A or G
gagtccaagataccactgataagrttccagcaaagagattaggacac

SEQ ID NO: 1357 - DNA, 47 bp, Homo Sapiens
  allele 24: 99-23269-263 : polymorphic base A or T
ctgaggtagatccaggactcagtwggcggctgtttttgaaggctgat

SEQ ID NO: 1358 - DNA, 47 bp, Homo Sapiens
  allele 24: 99-2328-535 : polymorphic base G or C
agtttcactgtttgaccactaaastagcaaaacaatgaatgaaattc

SEQ ID NO: 1359 - DNA, 47 bp, Homo Sapiens
  allele 24: 99-23299-424 : polymorphic base A or G
aatggggatgcattaaatgtgagrtcctagtgacagtgatcattagt

SEQ ID NO: 1360 - DNA, 47 bp, Homo Sapiens
  allele 24: 99-23302-326 : polymorphic base C or T
tttctctgaaattacacaatgtayttataacatgtcccctactatcc

SEQ ID NO: 1361 - DNA, 47 bp, Homo Sapiens
  allele 24: 99-2331-639 : polymorphic base G or T
tccccatgtggttctagtttccgkgtagcatctggaggctgtcatgt

SEQ ID NO: 1362 - DNA, 47 bp, Homo Sapiens
  allele 24: 99-23312-93 : polymorphic base A or G
ataagattaatcttttgtattttrttttaacattaaacttggtatat

SEQ ID NO: 1363 - DNA, 47 bp, Homo Sapiens
  allele 24: 99-23317-51 : polymorphic base A or G
aattagtaaagacatttatggtgrtatctcttactcattccagaagg

SEQ ID NO: 1364 - DNA, 47 bp, Homo Sapiens
  allele 24: 99-23322-49 : polymorphic base A or G
gatcccaaggctgcacctggttcraaggtgagcagaaattgtgactt

SEQ ID NO: 1365 - DNA, 47 bp, Homo Sapiens
  allele 24: 99-23326-120 : polymorphic base A or G
aaagaagagaatactcattttatrcctttaaccacaaatagtgttta

SEQ ID NO: 1366 - DNA, 47 bp, Homo Sapiens
  allele 24: 99-23328-292 : polymorphic base A or G
tgacccgctctcggccaggcggtrtatcgcccacatcaaaccctcct

SEQ ID NO: 1367 - DNA, 47 bp, Homo Sapiens
  allele 24: 99-23333-157 : polymorphic base A or G
aaccaatttgcttatattgtttcrttcttgtctaactctgcagaggt

SEQ ID NO: 1368 - DNA, 47 bp, Homo Sapiens
  allele 24: 99-23334-443 : polymorphic base A or G
ttaacaacttttactttttgtgtrttcaatgtaagttctgtcttatt

SEQ ID NO: 1369 - DNA, 47 bp, Homo Sapiens
  allele 24: 99-23359-99 : polymorphic base G or C
cagatcaccaaggtttctgatcastgaactgatagaggggtattctg

SEQ ID NO: 1370 - DNA, 47 bp, Homo Sapiens
  allele 24: 99-23381-412 : polymorphic base A or G
tagaagggctcaccttgaagggtrtcctcagtttcgaggccagggag

SEQ ID NO: 1371 - DNA, 47 bp, Homo Sapiens
  allele 24: 99-23387-404 : polymorphic base G or C
gtgtgtgtataatttaacaaattsttgaccactcagcttttagtcag

SEQ ID NO: 1372 - DNA, 47 bp, Homo Sapiens
  allele 24: 99-23413-242 : polymorphic base A or G
accagcctggaaacttaccatgcrgatgaggcaggcctcggttcacc

SEQ ID NO: 1373 - DNA, 47 bp, Homo Sapiens
  allele 24: 99-23415-131 : polymorphic base A or G
aaataggatgtcataggctacagrtgatagacaaagagaaaaattaa

SEQ ID NO: 1374 - DNA, 47 bp, Homo Sapiens
  allele 24: 99-23417-128 : polymorphic base G or T
gtcccattgctcggcaatgacackctttccagatgcattgacatcat

SEQ ID NO: 1375 - DNA, 47 bp, Homo Sapiens
  allele 24: 99-23437-347 : polymorphic base A or G
gaaatttcttctaaaacattcacrtgaactcagattgtgaaaatgag

SEQ ID NO: 1376 - DNA, 47 bp, Homo Sapiens
  allele 24: 99-23440-274 : polymorphic base A or G
atcactttaaagatatgcagtacrttgtatgacaagaaattgctttt

SEQ ID NO: 1377 - DNA, 47 bp, Homo Sapiens
  allele 24: 99-23444-203 : polymorphic base A or G
agttgctttgtccatccacttccrtgtttgtctcctcaagttccatg

SEQ ID NO: 1378 - DNA, 47 bp, Homo Sapiens
  allele 24: 99-2345-28 : polymorphic base G or C
ctccatttccatcccttyccaccscagccctagacaaccaccgatcc

SEQ ID NO: 1379 - DNA, 47 bp, Homo Sapiens
  allele 24: 99-23451-78 : polymorphic base A or G
agagctgcacaaaatccaaagctrtttataaaattctgtcccaatag

SEQ ID NO: 1380 - DNA, 47 bp, Homo Sapiens
  allele 24: 99-23452-306 : polymorphic base G or T
acagccctgaagctgtccttgtgkttcccatgtagtggaaacagggt

SEQ ID NO: 1381 - DNA, 47 bp, Homo Sapiens
  allele 24: 99-23454-317 : polymorphic base C or T
aacaccatccagccctcaaaataycgctacagttttttcatacccaa

SEQ ID NO: 1382 - DNA, 47 bp, Homo Sapiens
  allele 24: 99-23460-199 : polymorphic base A or C
ataaaacacaactaccaaaaactmtggatccagtgattaagagatac

SEQ ID NO: 1383 - DNA, 47 bp, Homo Sapiens
  allele 24: 99-23462-192 : polymorphic base C or T
cccacaatttaggggagttatgcygtctacctccttgaggaggcagc

SEQ ID NO: 1384 - DNA, 47 bp, Homo Sapiens
  allele 24: 99-23463-118 : polymorphic base C or T
ttttctttttagccatttggaccyatctcttagcatgcctgctaatt

SEQ ID NO: 1385 - DNA, 47 bp, Homo Sapiens
  allele 24: 99-23469-288 : polymorphic base C or T
gtcaaattacagtgcaattctagyaaggactagattagcggaaacat

SEQ ID NO: 1386 - DNA, 47 bp, Homo Sapiens
  allele 24: 99-2347-207 : polymorphic base A or C
tccgcactagactggaagttaccmatcagaagatgaggagaatgtta

SEQ ID NO: 1387 - DNA, 47 bp, Homo Sapiens
  allele 24: 99-23473-35 : polymorphic base C or T
acaacgggtcaccatctgtaaaaygtgtttatggaaaataaaacatg

SEQ ID NO: 1388 - DNA, 47 bp, Homo Sapiens
  allele 24: 99-2348-127 : polymorphic base A or G
ttaaagagattattttagcaaatrtttcattagtgtttgacttaaca

SEQ ID NO: 1389 - DNA, 47 bp, Homo Sapiens
  allele 24: 99-23488-239 : polymorphic base A or G
gacaccaatttttgattgctcagrtatgataaagtttctctaagaaa

SEQ ID NO: 1390 - DNA, 47 bp, Homo Sapiens
  allele 24: 99-23492-151 : polymorphic base C or T
cttgctcttataccctaataacgyccaatatatcactataagcttgc

SEQ ID NO: 1391 - DNA, 47 bp, Homo Sapiens
  allele 24: 99-23496-94 : polymorphic base A or G
accttcctattcacagattttcartgttatcctgtatttgtaagttt

SEQ ID NO: 1392 - DNA, 47 bp, Homo Sapiens
  allele 24: 99-23510-45 : polymorphic base A or G
agaggaaacaaacacatttctgcrtttaaaaaaatgccatttcctgg

SEQ ID NO: 1393 - DNA, 47 bp, Homo Sapiens
  allele 24: 99-23528-452 : polymorphic base C or T
aaattgggttgactgagttaaatyaggaacaaaagagccttgaggag

SEQ ID NO: 1394 - DNA, 47 bp, Homo Sapiens
  allele 24: 99-2356-322 : polymorphic base A or G
gtttgcctctgaagcactcaggtrtgcctgagtcacagaagagcctg

SEQ ID NO: 1395 - DNA, 47 bp, Homo Sapiens
  allele 24: 99-2362-270 : polymorphic base A or G
tctctcttgggtggttcctcaacrtgtgtgaccttgaccaagtattg

SEQ ID NO: 1396 - DNA, 47 bp, Homo Sapiens
  allele 24: 99-2364-329 : polymorphic base G or C
atataaaatgatgaaccatatacstgaggcaaggtaacatataattg

SEQ ID NO: 1397 - DNA, 47 bp, Homo Sapiens
  allele 24: 99-2367-61 : polymorphic base A or G
taaacatttcattatttcagaaartaatatgcattttcaccaacaca

SEQ ID NO: 1398 - DNA, 47 bp, Homo Sapiens
  allele 24: 99-2368-61 : polymorphic base A or G
tcctttgatggttcttttttgtcrtctctccatttaaatgaaatcat

SEQ ID NO: 1399 - DNA, 47 bp, Homo Sapiens
  allele 24: 99-23687-107 : polymorphic base C or T
ggcagtgtgtgaaaagataatgaygaattttccagcttgaagaaaaa

SEQ ID NO: 1400 - DNA, 47 bp, Homo Sapiens
  allele 24: 99-237-151 : polymorphic base A or G
aaaaagagattctgcaggccgccrcttaaaacagaattttatatcct

SEQ ID NO: 1401 - DNA, 47 bp, Homo Sapiens
  allele 24: 99-23714-196 : polymorphic base G or C
cctagctcaccacagcagctatasaaagacatctagaaagattttgc

SEQ ID NO: 1402 - DNA, 47 bp, Homo Sapiens
  allele 24: 99-23737-186 : polymorphic base C or T
ctccccagagagccttctcagcayccagtctaaatctaaacattcat

SEQ ID NO: 1403 - DNA, 47 bp, Homo Sapiens
  allele 24: 99-2375-114 : polymorphic base C or T
gcaacgctdaaccaagatcatctyggtatcgagcctgataattaata

SEQ ID NO: 1404 - DNA, 47 bp, Homo Sapiens
  allele 24: 99-23773-199 : polymorphic base C or T
tcatttataaagacgttttaagtyatctgtaggttcccttggtcatg

SEQ ID NO: 1405 - DNA, 47 bp, Homo Sapiens
  allele 24: 99-2378-200 : polymorphic base A or G
gagaacttcctgttgaacctgttrtagaactgtcctgtcgtccaaga

SEQ ID NO: 1406 - DNA, 47 bp, Homo Sapiens
  allele 24: 99-2381-394 : polymorphic base A or G
agtggtcttcaggttattggtagrgaaaagtaggggagctaaaggtg

SEQ ID NO: 1407 - DNA, 47 bp, Homo Sapiens
  allele 24: 99-2409-298 : polymorphic base A or G
aagtagcgcatggggctgcagccrcagatctcctgggctctgggtct

SEQ ID NO: 1408 - DNA, 47 bp, Homo Sapiens
  allele 24: 99-241-341 : polymorphic base A or T
ttagacaaatgtttagaataatcwattacgaattgtataggttccac

SEQ ID NO: 1409 - DNA, 47 bp, Homo Sapiens
  allele 24: 99-2413-368 : polymorphic base A or G
attttaagaggaaaacttaatggragaattgtacataatatttcatt

SEQ ID NO: 1410 - DNA, 47 bp, Homo Sapiens
  allele 24: 99-2417-177 : polymorphic base C or T
caatttttaattgtttttcactaygtacaccactctttgaaaactaa

SEQ ID NO: 1411 - DNA, 47 bp, Homo Sapiens
  allele 24: 99-2419-285 : polymorphic base C or T
aagggatcaagcagtgcccactcyccaccctccagggagctgtgact

SEQ ID NO: 1412 - DNA, 47 bp, Homo Sapiens
  allele 24: 99-24246-247 : polymorphic base C or T
tgtagtattctcctccttagttcygttgctttccctcttgcccttcc

SEQ ID NO: 1413 - DNA, 47 bp, Homo Sapiens
  allele 24: 99-24253-437 : polymorphic base A or G
tatcaagagttaaggtcccttcartagttcagctggtagagcagagg

SEQ ID NO: 1414 - DNA, 47 bp, Homo Sapiens
  allele 24: 99-24259-466 : polymorphic base A or T
ggaagcatggaagcatactttccwggggaaggctgactgtgctgaag

SEQ ID NO: 1415 - DNA, 47 bp, Homo Sapiens
  allele 24: 99-24264-380 : polymorphic base G or C
tgtatgctattcacaagaaaagtstttttaatcattaaaatgaaggg

SEQ ID NO: 1416 - DNA, 47 bp, Homo Sapiens
  allele 24: 99-24269-417 : polymorphic base C or T
agtcactgtgtagcaatttatggygaattttccaaagtggcaaataa

SEQ ID NO: 1417 - DNA, 47 bp, Homo Sapiens
  allele 24: 99-24270-207 : polymorphic base G or T
acaactcacttaacttggagcackaggcaaacttgtttgtggaggtg

SEQ ID NO: 1418 - DNA, 47 bp, Homo Sapiens
  allele 24: 99-24275-107 : polymorphic base A or G
gtaatgaaggctggagggccagcrggcatcctagattgtgagttgat

SEQ ID NO: 1419 - DNA, 47 bp, Homo Sapiens
  allele 24: 99-24284-213 : polymorphic base A or T
tggtgcccagaagatttcaagtawgaaattgttaatgagaacagttt

SEQ ID NO: 1420 - DNA, 47 bp, Homo Sapiens
  allele 24: 99-24286-231 : polymorphic base A or G
gattctgtctgtagttccccttcrtgctaccttatcgcaggtcctca

SEQ ID NO: 1421 - DNA, 47 bp, Homo Sapiens
  allele 24: 99-24288-121 : polymorphic base A or G
taaaattcttaattctttccatartcaatttggttggccttgaacgt

SEQ ID NO: 1422 - DNA, 47 bp, Homo Sapiens
  allele 24: 99-24333-37 : polymorphic base A or G
cttcctcccaagatatttcagtcrccttgaacaccttgcagtcactt

SEQ ID NO: 1423 - DNA, 47 bp, Homo Sapiens
  allele 24: 99-24342-311 : polymorphic base C or T
ctgatcctatcggaatccacccaygggtgagtctgggacaattcgat

SEQ ID NO: 1424 - DNA, 47 bp, Homo Sapiens
  allele 24: 99-24376-24 : polymorphic base A or G
cattagattgaaaaccagtgtctrtagttactaaagatcagtccaaa

SEQ ID NO: 1425 - DNA, 47 bp, Homo Sapiens
  allele 24: 99-24379-319 : polymorphic base C or T
ttttgaggactgaaggaccatagytggggaggagtcagatgagatgg

SEQ ID NO: 1426 - DNA, 47 bp, Homo Sapiens
  allele 24: 99-24381-217 : polymorphic base A or G
tggtgttttcatattaggtagagraacattttttagatgaaagcatg

SEQ ID NO: 1427 - DNA, 47 bp, Homo Sapiens
  allele 24: 99-24385-210 : polymorphic base A or T
agacaactcgggataagccaatawccccaccgagcagactccttccg

SEQ ID NO: 1428 - DNA, 47 bp, Homo Sapiens
  allele 24: 99-24388-391 : polymorphic base A or T
tttcatggttttacaaagtatttwgcaattactaaaatatgttggtt

SEQ ID NO: 1429 - DNA, 47 bp, Homo Sapiens
  allele 24: 99-24390-27 : polymorphic base A or G
cccagcagaatggcacggcttggrggaggggagagcctgctggccga

SEQ ID NO: 1430 - DNA, 47 bp, Homo Sapiens
  allele 24: 99-24392-61 : polymorphic base A or C
ccaggttgatgatgcaaactgaamgcagtgaatgccagggcccagaa

SEQ ID NO: 1431 - DNA, 47 bp, Homo Sapiens
  allele 24: 99-24393-108 : polymorphic base A or G
cccctacccaggtgcctgcctgtraggtgctctgccctcattctcgc

SEQ ID NO: 1432 - DNA, 47 bp, Homo Sapiens
  allele 24: 99-2440-246 : polymorphic base C or T
attcatcaatttaccatatcttgytcttatattaaaatgttctatca

SEQ ID NO: 1433 - DNA, 47 bp, Homo Sapiens
  allele 24: 99-24409-383 : polymorphic base A or G
aatcagacaccgctcccccacctrtggggctgacaatcatttkaact

SEQ ID NO: 1434 - DNA, 47 bp, Homo Sapiens
  allele 24: 99-24411-420 : polymorphic base G or C
acagtgctacctgcatgatacaastgtgggcaggacaggccaggtct

SEQ ID NO: 1435 - DNA, 47 bp, Homo Sapiens
  allele 24: 99-24427-321 : polymorphic base A or G
cttatcttaatttccagattcacrttctgattatttccataaaaaca

SEQ ID NO: 1436 - DNA, 47 bp, Homo Sapiens
  allele 24: 99-24432-284 : polymorphic base A or C
tttcccggtcactctaaggcaacmaaggcaagaccttttctgttcct

SEQ ID NO: 1437 - DNA, 47 bp, Homo Sapiens
  allele 24: 99-24438-402 : polymorphic base A or G
agctcttgtaccttattttggctraagacttccttcaccgtgcttct

SEQ ID NO: 1438 - DNA, 47 bp, Homo Sapiens
  allele 24: 99-24441-431 : polymorphic base C or T
caccgtcatcatcctcacctccayctccccccaacatctttcttccc

SEQ ID NO: 1439 - DNA, 47 bp, Homo Sapiens
  allele 24: 99-24447-448 : polymorphic base A or T
cttaattcacgccccattcatcawctcatttagaattcgactatccc

SEQ ID NO: 1440 - DNA, 47 bp, Homo Sapiens
  allele 24: 99-2445-79 : polymorphic base C or T
tttaggtatggcgavgattattayggttctaagagtcagcaaactcc

SEQ ID NO: 1441 - DNA, 47 bp, Homo Sapiens
  allele 24: 99-24454-257 : polymorphic base G or C
aatacatgagaaatgttattatasgtattagccttaattgtctctgt

SEQ ID NO: 1442 - DNA, 47 bp, Homo Sapiens
  allele 24: 99-24463-206 : polymorphic base A or G
tatgctgtttccttgagatataartcctgggtctgaggtctttcagt

SEQ ID NO: 1443 - DNA, 47 bp, Homo Sapiens
  allele 24: 99-24496-171 : polymorphic base C or T
attcattctgctcagctgcagaayggcagctccatgggtctacccca

SEQ ID NO: 1444 - DNA, 47 bp, Homo Sapiens
  allele 24: 99-24506-396 : polymorphic base A or G
gtgcccacctccaggccaggctgrttgtacctcggtggggggctcct

SEQ ID NO: 1445 - DNA, 47 bp, Homo Sapiens
  allele 24: 99-24508-45 : polymorphic base G or C
gcccagaaggcaatgtctgctgtsggcaggaccacagaggctgccca

SEQ ID NO: 1446 - DNA, 47 bp, Homo Sapiens
  allele 24: 99-24529-330 : polymorphic base A or G
cagccctgactcacatcctcctcrtctcatctggcccagtgggacag

SEQ ID NO: 1447 - DNA, 47 bp, Homo Sapiens
  allele 24: 99-24534-317 : polymorphic base G or C
ggtgaagagggagagaaactgcasctattttctcctgactctagagc

SEQ ID NO: 1448 - DNA, 47 bp, Homo Sapiens
  allele 24: 99-24554-324 : polymorphic base A or G
gtgtgtgctgccaagcggggcagrtttgggcctgaactgcttcccca

SEQ ID NO: 1449 - DNA, 47 bp, Homo Sapiens
  allele 24: 99-24557-406 : polymorphic base G or T
cagtgattgtgaagattttgttcktacactaatatggatcacttaga

SEQ ID NO: 1450 - DNA, 47 bp, Homo Sapiens
  allele 24: 99-24561-360 : polymorphic base A or T
attccattaaaaattttcaaaatwacctcttcattgtccttggtgct

SEQ ID NO: 1451 - DNA, 47 bp, Homo Sapiens
  allele 24: 99-24570-260 : polymorphic base G or C
cgccaaaagcttcttcccttggasgagagagggaatcctctcatgcc

SEQ ID NO: 1452 - DNA, 47 bp, Homo Sapiens
  allele 24: 99-24688-312 : polymorphic base C or T
tctaggatggaaaccaaggcataygtagggaagcagttatagatggg

SEQ ID NO: 1453 - DNA, 47 bp, Homo Sapiens
  allele 24: 99-24725-138 : polymorphic base A or G
accaaacccattgcagcagccccrccctcatcgccccccacacaact

SEQ ID NO: 1454 - DNA, 47 bp, Homo Sapiens
  allele 24: 99-24727-360 : polymorphic base A or G
aaactacatgtaagagatgcaaartaagcctaccacttcctttgctt

SEQ ID NO: 1455 - DNA, 47 bp, Homo Sapiens
  allele 24: 99-24750-293 : polymorphic base C or T
gaggagcactaggtaaatatctgytatcattattaaaagtccaattt

SEQ ID NO: 1456 - DNA, 47 bp, Homo Sapiens
  allele 24: 99-24778-221 : polymorphic base C or T
ctctgaggtctggcagtgtctccyttcccgccctcccagggcccctg

SEQ ID NO: 1457 - DNA, 47 bp, Homo Sapiens
  allele 24: 99-24793-390 : polymorphic base C or T
ccctgccatctaaatcaggcaatyggtaagtccttttgatcttactt

SEQ ID NO: 1458 - DNA, 47 bp, Homo Sapiens
  allele 24: 99-24800-565 : polymorphic base G or T
agcaggcttccatgatactcaagkcgtctgcctctcctggtggaatc

SEQ ID NO: 1459 - DNA, 47 bp, Homo Sapiens
  allele 24: 99-25005-154 : polymorphic base A or C
aatttctcagggattcctgatgamagtgagtggactcactcccaggt

SEQ ID NO: 1460 - DNA, 47 bp, Homo Sapiens
  allele 24: 99-25007-131 : polymorphic base A or T
gattccagcagcaacttgtcagcwccttgctctgcttcagggcttcg

SEQ ID NO: 1461 - DNA, 47 bp, Homo Sapiens
  allele 24: 99-25053-114 : polymorphic base A or G
aggcaggaggatttcttgaggccrggagtttgagaccagcctggcca

SEQ ID NO: 1462 - DNA, 47 bp, Homo Sapiens
  allele 24: 99-25055-44 : polymorphic base A or G
tagtcacgtttaaaagcgccatcrccagaagtagccaactgaataac

SEQ ID NO: 1463 - DNA, 47 bp, Homo Sapiens
  allele 24: 99-25070-78 : polymorphic base C or T
gcttccaaattaccaccccacccygggggaggtcttatgattcatgg

SEQ ID NO: 1464 - DNA, 47 bp, Homo Sapiens
  allele 24: 99-25077-124 : polymorphic base A or G
acttaattttgtatccaaagtatrttacatgctatctgactcctggt

SEQ ID NO: 1465 - DNA, 47 bp, Homo Sapiens
  allele 24: 99-25129-166 : polymorphic base C or T
tccacagcagtgacaaatggtaaygtaagtgaaagaaaagagtaaaa

SEQ ID NO: 1466 - DNA, 47 bp, Homo Sapiens
  allele 24: 99-25134-296 : polymorphic base A or G
ttatgagaaagtcttggatttatrttgcttccagcacatttggcagg

SEQ ID NO: 1467 - DNA, 47 bp, Homo Sapiens
  allele 24: 99-2524-98 : polymorphic base A or G
aaacccacagaatggcaagcctcrcactggggagaggagaccccggc

SEQ ID NO: 1468 - DNA, 47 bp, Homo Sapiens
  allele 24: 99-25246-170 : polymorphic base C or T
ttgtgctgtcatcagagctgagcycatctccctccactgcgagaccc

SEQ ID NO: 1469 - DNA, 47 bp, Homo Sapiens
  allele 24: 99-25249-151 : polymorphic base G or T
gaatcaatattaagataggaaagkatagtgcttcctttcccaaactg

SEQ ID NO: 1470 - DNA, 47 bp, Homo Sapiens
  allele 24: 99-2525-142 : polymorphic base A or G
ctagtaacctttttactatctctrtgtatctgtaacaccatgttgca

SEQ ID NO: 1471 - DNA, 47 bp, Homo Sapiens
  allele 24: 99-25255-288 : polymorphic base C or T
ttttatatttggcttcttaatgayatcaatcatattctaatggacgt

SEQ ID NO: 1472 - DNA, 47 bp, Homo Sapiens
  allele 24: 99-25369-121 : polymorphic base C or T
aaagaaaacaccagagggtgccaytgagcagcagaagaaacatgaac

SEQ ID NO: 1473 - DNA, 47 bp, Homo Sapiens
  allele 24: 99-25379-389 : polymorphic base C or T
tcctagccaccggtggaggagcaycacacactctgcggttggaggga

SEQ ID NO: 1474 - DNA, 47 bp, Homo Sapiens
  allele 24: 99-25382-226 : polymorphic base A or C
cacttagttaggaggcaggagctmacccataggagcgggaggccggg

SEQ ID NO: 1475 - DNA, 47 bp, Homo Sapiens
  allele 24: 99-25387-220 : polymorphic base G or T
caccttcttgctgcatatgcagtkgaggtgaaaacttctgtgcatct

SEQ ID NO: 1476 - DNA, 47 bp, Homo Sapiens
  allele 24: 99-25400-379 : polymorphic base C or T
ggcaatattgggagggggaataayttgtggccagtttgtgatctacc

SEQ ID NO: 1477 - DNA, 47 bp, Homo Sapiens
  allele 24: 99-25412-354 : polymorphic base G or T
gacctacttcattttccatttctkcagctgacctttccccatagcta

SEQ ID NO: 1478 - DNA, 47 bp, Homo Sapiens
  allele 24: 99-25431-269 : polymorphic base A or C
gtggtaaaggaagacaggaaacamagaatatctagaaggttatctca

SEQ ID NO: 1479 - DNA, 47 bp, Homo Sapiens
  allele 24: 99-25432-119 : polymorphic base C or T
tggaatcagcagtgatggttgtgyaatcctataagtacataaaccac

SEQ ID NO: 1480 - DNA, 47 bp, Homo Sapiens
  allele 24: 99-25433-351 : polymorphic base A or G
ctcagctgcactttctgcccaagrcctctgtattcacattacagaaa

SEQ ID NO: 1481 - DNA, 47 bp, Homo Sapiens
  allele 24: 99-25447-272 : polymorphic base A or G
atatataatacatacacaaatatratatgtggatatagcattgtatt

SEQ ID NO: 1482 - DNA, 47 bp, Homo Sapiens
  allele 24: 99-25448-348 : polymorphic base G or T
tagggaatggctgtgagaccccaktccaagcccagctgtctgctttg

SEQ ID NO: 1483 - DNA, 47 bp, Homo Sapiens
  allele 24: 99-25452-83 : polymorphic base C or T
agagtgtccgcagaggctcttccygtgctgttccattatcttttctc

SEQ ID NO: 1484 - DNA, 47 bp, Homo Sapiens
  allele 24: 99-25454-349 : polymorphic base G or T
caaggacagtatgtgagagctgtkcagtggtcaggtttttccctgcc

SEQ ID NO: 1485 - DNA, 47 bp, Homo Sapiens
  allele 24: 99-25458-103 : polymorphic base G or C
accaaattatgatcaagtgaaggsaaaaaaagagaattatagacaaa

SEQ ID NO: 1486 - DNA, 47 bp, Homo Sapiens
  allele 24: 99-25503-333 : polymorphic base A or T
agcctccttcctttctcagtcacwcttgcccattctccagctgattt

SEQ ID NO: 1487 - DNA, 47 bp, Homo Sapiens
  allele 24: 99-25507-373 : polymorphic base C or T
tttaactggatctaaactgtaaaytgaataatatctttaaagttatc

SEQ ID NO: 1488 - DNA, 47 bp, Homo Sapiens
  allele 24: 99-25510-390 : polymorphic base A or C
cccatatatcagccaaacatcagmtaaatctcactattctcctttcg

SEQ ID NO: 1489 - DNA, 47 bp, Homo Sapiens
  allele 24: 99-25538-423 : polymorphic base A or C
ctttattttccatgaagattcctmacaataaaaattcacaatacaaa

SEQ ID NO: 1490 - DNA, 47 bp, Homo Sapiens
  allele 24: 99-25539-86 : polymorphic base C or T
attttaagctgaggttaaattcgyatatgtgtacaaagcaggagagg

SEQ ID NO: 1491 - DNA, 47 bp, Homo Sapiens
  allele 24: 99-25543-390 : polymorphic base A or G
cttctgacccttacccagttatcragcaactccaacatatttactgc

SEQ ID NO: 1492 - DNA, 47 bp, Homo Sapiens
  allele 24: 99-25575-303 : polymorphic base C or T
agattagtgaaagaatacacgtayaccccctaaataaaaaaaaaaag

SEQ ID NO: 1493 - DNA, 47 bp, Homo Sapiens
  allele 24: 99-25618-196 : polymorphic base A or C
tgatcccaatgcatttaaatgtgmctgcttttcttcttttgctaaca

SEQ ID NO: 1494 - DNA, 47 bp, Homo Sapiens
  allele 24: 99-25620-360 : polymorphic base C or T
agctaacagttatacccataaatyctcattctcttaaataaatttaa

SEQ ID NO: 1495 - DNA, 47 bp, Homo Sapiens
  allele 24: 99-25629-262 : polymorphic base A or G
actgctggcttccaatcctggtgrctcatagtccttgaatacttctc

SEQ ID NO: 1496 - DNA, 47 bp, Homo Sapiens
  allele 24: 99-25657-314 : polymorphic base C or T
tttaaactctcagtctcctgaccygcatacgtggccaaaaacccaac

SEQ ID NO: 1497 - DNA, 47 bp, Homo Sapiens
  allele 24: 99-25672-97 : polymorphic base A or G
gtcttctgtaaggagtttcttcartatttgaaaagtgcagaatctct

SEQ ID NO: 1498 - DNA, 47 bp, Homo Sapiens
  allele 24: 99-25676-211 : polymorphic base C or T
atataatttttaaaaataaacttytgattgtttaaagccattgaaat

SEQ ID NO: 1499 - DNA, 47 bp, Homo Sapiens
  allele 24: 99-25678-307 : polymorphic base A or G
attatcctgtttcagtatttctcrtaatggacacatattgtttattc

SEQ ID NO: 1500 - DNA, 47 bp, Homo Sapiens
  allele 24: 99-2570-218 : polymorphic base C or T
ggaaagttccaaattatgagaagygaggcctctgaagtggctaagtt

SEQ ID NO: 1501 - DNA, 47 bp, Homo Sapiens
  allele 24: 99-25712-418 : polymorphic base C or T
ttttcagaagcatttgggcgtccyaatgatttctacttctaaagagt

SEQ ID NO: 1502 - DNA, 47 bp, Homo Sapiens
  allele 24: 99-25716-393 : polymorphic base C or T
ggggaacagcatttacagaggcayggggcaggacatagcaaatcgtc

SEQ ID NO: 1503 - DNA, 47 bp, Homo Sapiens
  allele 24: 99-25717-252 : polymorphic base G or T
agggcccctctgtggtgaggcgtkctgctcggtgtaaaacacacacg

SEQ ID NO: 1504 - DNA, 47 bp, Homo Sapiens
  allele 24: 99-25725-80 : polymorphic base A or G
actaggcattagttttaaaatatrtgagacagagtgggccaaatata

SEQ ID NO: 1505 - DNA, 47 bp, Homo Sapiens
  allele 24: 99-25732-152 : polymorphic base A or G
attgatttttcctaaagctaaaarattatcaagcaacttccctctcc

SEQ ID NO: 1506 - DNA, 47 bp, Homo Sapiens
  allele 24: 99-25745-36 : polymorphic base A or G
cagaaggtacctcccaggagagarccacatgcagtaaaagcctggtg

SEQ ID NO: 1507 - DNA, 47 bp, Homo Sapiens
  allele 24: 99-25781-275 : polymorphic base C or T
aataaattattctcctgttcataytgactctgtgcaatgacattgca

SEQ ID NO: 1508 - DNA, 47 bp, Homo Sapiens
  allele 24: 99-25836-106 : polymorphic base C or T
aaaagggcctggtttatattttgygtgatctcttaaagaaatagaga

SEQ ID NO: 1509 - DNA, 47 bp, Homo Sapiens
  allele 24: 99-2597-34 : polymorphic base C or T
gaagccacctgaatgtcccaagaygggaagcggtttaaaccagcaca

SEQ ID NO: 1510 - DNA, 47 bp, Homo Sapiens
  allele 24: 99-26001-224 : polymorphic base A or G
ctctgctccccttctaagcctctrttttcctatccataaaatgagga

SEQ ID NO: 1511 - DNA, 47 bp, Homo Sapiens
  allele 24: 99-26002-93 : polymorphic base C or T
atctattatttttgctcctccacyattaattgaccttcctgataata

SEQ ID NO: 1512 - DNA, 47 bp, Homo Sapiens
  allele 24: 99-26042-310 : polymorphic base A or G
ttctggaaggaatgtgaaataaartaactaccaaggagcacatgttc

SEQ ID NO: 1513 - DNA, 47 bp, Homo Sapiens
  allele 24: 99-26080-152 : polymorphic base C or T
ttctttttggctcccccagtaggytatactgtgaagtctttccattg

SEQ ID NO: 1514 - DNA, 47 bp, Homo Sapiens
  allele 24: 99-26082-48 : polymorphic base C or T
cctccttccctgtagatggataayaaccatctgtactggcacctgcc

SEQ ID NO: 1515 - DNA, 47 bp, Homo Sapiens
  allele 24: 99-26099-119 : polymorphic base A or G
ctactagccttttacccagggtcrctttctaaggttgttagtcacaa

SEQ ID NO: 1516 - DNA, 47 bp, Homo Sapiens
  allele 24: 99-2610-121 : polymorphic base A or C
ataccccttccctaggtatggctmtatgctgcacttagaaaattctc

SEQ ID NO: 1517 - DNA, 47 bp, Homo Sapiens
  allele 24: 99-26105-273 : polymorphic base A or C
catctactttgtatggagagagamgtgggtcatggactcctgggttg

SEQ ID NO: 1518 - DNA, 47 bp, Homo Sapiens
  allele 24: 99-26116-191 : polymorphic base C or T
tgtcactgagtgttccagagatayggtagcttcaggtattgctgtat

SEQ ID NO: 1519 - DNA, 47 bp, Homo Sapiens
  allele 24: 99-2615-83 : polymorphic base C or T
aacaaatcacaagttggcaaaagyagcaaattctcatcttctgggaa

SEQ ID NO: 1520 - DNA, 47 bp, Homo Sapiens
  allele 24: 99-2620-227 : polymorphic base A or G
ttgactgggctcctgatgtgtccrgggtatcttgctggctgttttgc

SEQ ID NO: 1521 - DNA, 44 bp, Homo Sapiens
  allele 24: 99-2624-407 : polymorphic base G or T
atctggccataggcagaacattgkgggagagatggggaaagaga

SEQ ID NO: 1522 - DNA, 47 bp, Homo Sapiens
  allele 24: 99-2625-70 : polymorphic base A or G
agtgactcaaccagaaagagagcrggagagaggacgaagagaggaga

SEQ ID NO: 1523 - DNA, 47 bp, Homo Sapiens
  allele 24: 99-2637-28 : polymorphic base A or G
ccatcacttcctcctagtgaaaartcaaaggagggtgggttttatag

SEQ ID NO: 1524 - DNA, 47 bp, Homo Sapiens
  allele 24: 99-2662-407 : polymorphic base C or T
gagctagaaatactcaaatctcaygaaagatatatccagaatgatct

SEQ ID NO: 1525 - DNA, 47 bp, Homo Sapiens
  allele 24: 99-2669-233 : polymorphic base A or G
catagcagaacatatcatttggtrcaagaccatctttaaatctctaa

SEQ ID NO: 1526 - DNA, 47 bp, Homo Sapiens
  allele 24: 99-2675-121 : polymorphic base A or G
agttaatttacattttgctttcartaaagtcatacctcttattttta

SEQ ID NO: 1527 - DNA, 47 bp, Homo Sapiens
  allele 24: 99-2683-388 : polymorphic base C or T
caggaataactaaagaacctacaycccaaggtgagtttaaatctcta

SEQ ID NO: 1528 - DNA, 47 bp, Homo Sapiens
  allele 24: 99-342-288 : polymorphic base A or C
cacatccacttcccccatccctgmatgcaaggcataactgggacaga

SEQ ID NO: 1529 - DNA, 47 bp, Homo Sapiens
  allele 24: 99-370-205 : polymorphic base A or G
acagctccatgcaaaaaaagtaartagagacacagaccttaaacctt

SEQ ID NO: 1530 - DNA, 47 bp, Homo Sapiens
  allele 24: 99-371-415 : polymorphic base C or T
aggcaccactggccacggaggttyctggctggaaaagcaacacccga

SEQ ID NO: 1531 - DNA, 47 bp, Homo Sapiens
  allele 24: 99-388-405 : polymorphic base A or G
cacaaaccctactttataataaartgttgaatatctcatgcaactta

SEQ ID NO: 1532 - DNA, 47 bp, Homo Sapiens
  allele 24: 99-390-246 : polymorphic base G or T
atatagaggagggcagcaaatatkcatgagtctatcacagatgtccc

SEQ ID NO: 1533 - DNA, 47 bp, Homo Sapiens
  allele 24: 99-393-448 : polymorphic base A or T
agatgtatcttatcagcttaacawcctcagtggaaaaaggagacttt

SEQ ID NO: 1534 - DNA, 47 bp, Homo Sapiens; identical to SEQ ID NO: 1529
  allele 24: 99-397-205 : polymorphic base A or G

SEQ ID NO: 1535 - DNA, 47 bp, Homo Sapiens
  allele 24: 99-400-102 : polymorphic base G or C
ggcctgacttattccctgagaacscttcttcaatctactattctatg

SEQ ID NO: 1536 - DNA, 47 bp, Homo Sapiens; identical to SEQ ID NO: 1529
  allele 24: 99-402-139 : polymorphic base A or G

SEQ ID NO: 1537 - DNA, 47 bp, Homo Sapiens
  allele 24: 99-404-114 : polymorphic base C or T
gagaagggagaagggttaggggayccaaggaccacaacatggacatg

SEQ ID NO: 1538 - DNA, 47 bp, Homo Sapiens
  allele 24: 99-414-349 : polymorphic base G or C
gttacactcaattcacttggtacsatcctggttttgtagggcccatg

SEQ ID NO: 1539 - DNA, 47 bp, Homo Sapiens
  allele 24: 99-417-241 : polymorphic base A or G
agtaccaaagtgtctggcatatartgagtaggcactcaaatgttcag

SEQ ID NO: 1540 - DNA, 47 bp, Homo Sapiens
  allele 24: 99-426-359 : polymorphic base G or T
tgaaactagcattctctccatgtktattctgtcaaataatcctttaa

SEQ ID NO: 1541 - DNA, 47 bp, Homo Sapiens
  allele 24: 99-429-115 : polymorphic base A or C
ttaaaggattatttgacagaatamacatggagagaatgctagtttca

SEQ ID NO: 1542 - DNA, 47 bp, Homo Sapiens
  allele 24: 99-430-352 : polymorphic base C or T
acttgcaaactaacacgttagccygccacagttatcctgctggtaga

SEQ ID NO: 1543 - DNA, 47 bp, Homo Sapiens
  allele 24: 99-435-41 : polymorphic base A or G
aggtcttacgtctcttttgtcagrtttatctgtaagcgtttcattat

SEQ ID NO: 1544 - DNA, 47 bp, Homo Sapiens
  allele 24: 99-449-344 : polymorphic base G or T
catctgctattcattttaaacttkcacccacaaaacaatctaagcta

SEQ ID NO: 1545 - DNA, 47 bp, Homo Sapiens
  allele 24: 99-4536-255 : polymorphic base A or G
ctcccaaagtgccgggattacagrcgtgagccaccgtaccagccccc

SEQ ID NO: 1546 - DNA, 47 bp, Homo Sapiens
  allele 24: 99-4541-39 : polymorphic base G or T
ctcytctacttctcttttcttccktttctcttactattgtctgatac

SEQ ID NO: 1547 - DNA, 47 bp, Homo Sapiens
  allele 24: 99-4544-287 : polymorphic base A or G
ggcgttctgctcagcccacgctcrtctaactggcccccaggcaccac

SEQ ID NO: 1548 - DNA, 47 bp, Homo Sapiens
  allele 24: 99-4547-312 : polymorphic base C or T
tgtcccccagccccacttccaccygagacattcacacaccccatttc

SEQ ID NO: 1549 - DNA, 47 bp, Homo Sapiens
  allele 24: 99-4595-341 : polymorphic base A or T
gagaccaaccagtaccatgaatgwctgggacatttactattacattc

SEQ ID NO: 1550 - DNA, 47 bp, Homo Sapiens
  allele 24: 99-4604-26 : polymorphic base A or T
ctgtgcattttgacccaactttcwagaagctttccagaagcttctag

SEQ ID NO: 1551 - DNA, 47 bp, Homo Sapiens
  allele 24: 99-4618-240 : polymorphic base C or T
ctaagcactcaacacagcctggayagatatatgttcagtgaatactt

SEQ ID NO: 1552 - DNA, 47 bp, Homo Sapiens
  allele 24: 99-4625-216 : polymorphic base C or T
tcactttttgcagttgactcattyccctgcccccaaatgtgtgttaa

SEQ ID NO: 1553 - DNA, 47 bp, Homo Sapiens
  allele 24: 99-4630-272 : polymorphic base A or G
gcttctgttcatttcccatctttrttatggatggtggtgacattttt

SEQ ID NO: 1554 - DNA, 47 bp, Homo Sapiens
  allele 24: 99-4644-107 : polymorphic base A or T
gacttctccacctcctaggcacawgatagcatcacctttaactggcc

SEQ ID NO: 1555 - DNA, 47 bp, Homo Sapiens
  allele 24: 99-465-443 : polymorphic base A or C
gtggtcggcagcgttgcatgggcmtctcccgcggtccttgggattgg

SEQ ID NO: 1556 - DNA, 47 bp, Homo Sapiens
  allele 24: 99-4655-145 : polymorphic base C or T
atgtgtggtgctgttgaaaatgayggtagattgcacttcatatgttc

SEQ ID NO: 1557 - DNA, 47 bp, Homo Sapiens
  allele 24: 99-466-361 : polymorphic base C or T
gccacactccctgctgacgtgagygtgggagcaaagtgctgcacttg

SEQ ID NO: 1558 - DNA, 47 bp, Homo Sapiens
  allele 24: 99-4666-185 : polymorphic base C or T
ccaccactttcattgcttcgcacyctgcccgtcactgccttgtgcga

SEQ ID NO: 1559 - DNA, 47 bp, Homo Sapiens
  allele 24: 99-4674-166 : polymorphic base A or G
agcttagctatttaaaattctttrtcttgtaactatttgttagattt

SEQ ID NO: 1560 - DNA, 47 bp, Homo Sapiens
  allele 24: 99-4676-342 : polymorphic base A or G
actacccataaataaaatgctgcraacccaaccgtttccctttagaa

SEQ ID NO: 1561 - DNA, 47 bp, Homo Sapiens
  allele 24: 99-4677-58 : polymorphic base C or T
tgagcactgagatgcctccacagyagcagccttctcctctttccatc

SEQ ID NO: 1562 - DNA, 47 bp, Homo Sapiens
  allele 24: 99-4679-240 : polymorphic base C or T
attaccaaagcaagtggggccggyagagactgagactgcagaggctg

SEQ ID NO: 1563 - DNA, 47 bp, Homo Sapiens
  allele 24: 99-4680-352 : polymorphic base C or T
agtgaaaagtgtccctttttactytagtaatgtcattagagctgtca

SEQ ID NO: 1564 - DNA, 47 bp, Homo Sapiens
  allele 24: 99-4681-228 : polymorphic base A or G
tctccagtgggaaattacattgaraagtttatttcctgagcatttcc

SEQ ID NO: 1565 - DNA, 47 bp, Homo Sapiens
  allele 24: 99-4682-177 : polymorphic base C or T
atgcaaggatggttcaacatttgyaaatcaatcaatgcgatacatta

SEQ ID NO: 1566 - DNA, 47 bp, Homo Sapiens
  allele 24: 99-4685-217 : polymorphic base A or G
gtgaaacgtgaaaaccgagttgtrggcagcaccctcggaggctctgg

SEQ ID NO: 1567 - DNA, 47 bp, Homo Sapiens
  allele 24: 99-4705-226 : polymorphic base G or C
caatgaacaatgatttgcagatasactgacttctcttcagaagcgat

SEQ ID NO: 1568 - DNA, 47 bp, Homo Sapiens
  allele 24: 99-4714-156 : polymorphic base A or G
ctcatcaccctctgtgttagtccrttctcacattgctataaagatac

SEQ ID NO: 1569 - DNA, 47 bp, Homo Sapiens
  allele 24: 99-472-70 : polymorphic base C or T
tgaagatgaagacagcctagatcytgagagcagagaatgtaaaagca

SEQ ID NO: 1570 - DNA, 47 bp, Homo Sapiens
  allele 24: 99-4725-251 : polymorphic base A or T
tagatgaatgcacacttacacgawaacatatagcttagaaggtatat

SEQ ID NO: 1571 - DNA, 47 bp, Homo Sapiens
  allele 24: 99-4756-236 : polymorphic base C or T
tcatttaattcccaggtcaatctygcagggtaggtattgctgacatc

SEQ ID NO: 1572 - DNA, 47 bp, Homo Sapiens
  allele 24: 99-4761-279 : polymorphic base A or G
agtcaggggagagcagcttctgcratgcactctgttgctgccctggt

SEQ ID NO: 1573 - DNA, 47 bp, Homo Sapiens
  allele 24: 99-477-302 : polymorphic base A or G
ctaaatgtagaaatgaaaattatrcaattcttaaaatatggattaaa

SEQ ID NO: 1574 - DNA, 47 bp, Homo Sapiens
  allele 24: 99-4777-137 : polymorphic base G or C
cagtatgcatgaggtaagggaagscttctctgaagcagggactgata

SEQ ID NO: 1575 - DNA, 47 bp, Homo Sapiens
  allele 24: 99-4790-305 : polymorphic base A or G
ttgctatagagcatataatggggrtacatttctattcattgcttctc

SEQ ID NO: 1576 - DNA, 47 bp, Homo Sapiens
  allele 24: 99-4796-325 : polymorphic base A or C
ctaaactatggtattcacatcatmaagaatgtacacgatggatatat

SEQ ID NO: 1577 - DNA, 47 bp, Homo Sapiens
  allele 24: 99-482-130 : polymorphic base C or T
gtgcaggatctcaccacacagtcyggtggagctagaccgactatgca

SEQ ID NO: 1578 - DNA, 47 bp, Homo Sapiens
  allele 24: 99-4822-291 : polymorphic base A or G
cacagttctgagaagcacgagccrgggtgtattgctgtccctgccag

SEQ ID NO: 1579 - DNA, 47 bp, Homo Sapiens
  allele 24: 99-4823-173 : polymorphic base G or T
ggaggcattattccatattatagkgcagaaaagaaagccaagcagga

SEQ ID NO: 1580 - DNA, 47 bp, Homo Sapiens
  allele 24: 99-483-424 : polymorphic base A or C
caaaggagactgagagaatacaamtagtaagaaagaagaataaataa

SEQ ID NO: 1581 - DNA, 47 bp, Homo Sapiens
  allele 24: 99-4836-206 : polymorphic base A or G
ttctagtgaaaaagacagataatragaagcaaataaacaaacacatt

SEQ ID NO: 1582 - DNA, 47 bp, Homo Sapiens
  allele 24: 99-4838-424 : polymorphic base C or T
acctgatagtgagctgtggctctyctgatgatgcactctggtgtgtc

SEQ ID NO: 1583 - DNA, 47 bp, Homo Sapiens
  allele 24: 99-4840-368 : polymorphic base C or T
tcactgccattctaggagggaggytcdcatacattgtctccaggagg

SEQ ID NO: 1584 - DNA, 47 bp, Homo Sapiens
  allele 24: 99-4844-102 : polymorphic base C or T
cctgttggtccagggagcagagayctaagggggaattaattcctctc

SEQ ID NO: 1585 - DNA, 47 bp, Homo Sapiens
  allele 24: 99-486-243 : polymorphic base C or T
gtcatcaccagggaagcagtttgyacctgagtaccgcctgacattgt

SEQ ID NO: 1586 - DNA, 47 bp, Homo Sapiens
  allele 24: 99-4863-240 : polymorphic base C or T
gtgggattaactactgagcagtcygaaatgagagaagaacagaagaa

SEQ ID NO: 1587 - DNA, 47 bp, Homo Sapiens
  allele 24: 99-4882-351 : polymorphic base A or T
cttctgtgaattaggatctggaawatttttgactcacagtggtagga

SEQ ID NO: 1588 - DNA, 47 bp, Homo Sapiens
  allele 24: 99-4890-255 : polymorphic base G or T
taatcggccaacagtttgtacttkgtcactgatgggctcatccctga

SEQ ID NO: 1589 - DNA, 47 bp, Homo Sapiens
  allele 24: 99-4891-509 : polymorphic base A or C
gatatgtaatctatggtgcaagcmcctaaaatctttaatcatattga

SEQ ID NO: 1590 - DNA, 47 bp, Homo Sapiens
  allele 24: 99-4895-158 : polymorphic base C or T
gtcccctcacttggtaccagaaayggcatatggtgatatgaagcaga

SEQ ID NO: 1591 - DNA, 47 bp, Homo Sapiens
  allele 24: 99-490-202 : polymorphic base C or T
tgcttgaggtcttcagtgcttgcyttcttcatgtagaggtgcagagg

SEQ ID NO: 1592 - DNA, 47 bp, Homo Sapiens
  allele 24: 99-4924-254 : polymorphic base C or T
tatgtatctgtctccagtgtagaytagccagtatggccagcattttc

SEQ ID NO: 1593 - DNA, 47 bp, Homo Sapiens
  allele 24: 99-4928-102 : polymorphic base C or T
agattgagcatttggcccagccaycagatatgcagttcagaacaaag

SEQ ID NO: 1594 - DNA, 47 bp, Homo Sapiens
  allele 24: 99-4950-196 : polymorphic base A or C
agggtgcctagatgagagagcccmccgggctagagctgcatgaaatg

SEQ ID NO: 1595 - DNA, 47 bp, Homo Sapiens
  allele 24: 99-4951-36 : polymorphic base C or T
atagccctaggcaggggctgccayccggggatcagctgcgttctgat

SEQ ID NO: 1596 - DNA, 47 bp, Homo Sapiens
  allele 24: 99-4956-236 : polymorphic base A or G
attcatatgacctcaaatagtaarctaataggaaaatcactgggata

SEQ ID NO: 1597 - DNA, 47 bp, Homo Sapiens
  allele 24: 99-4966-298 : polymorphic base A or G
ttgtttctccagtttatggaaagrggcaatgtcatcaagtttttaga

SEQ ID NO: 1598 - DNA, 47 bp, Homo Sapiens
  allele 24: 99-4968-273 : polymorphic base C or T
tgagaaaaactgaatggatttgaycgcaatccccaccattcagatta

SEQ ID NO: 1599 - DNA, 47 bp, Homo Sapiens
  allele 24: 99-5016-206 : polymorphic base C or T
atccccactctgcccttgagttcytctgagccataatagtttttcag

SEQ ID NO: 1600 - DNA, 47 bp, Homo Sapiens
  allele 24: 99-5029-240 : polymorphic base G or T
gatcctggaaggtcaagaaacagkaattggaagtgtccttccagtat

SEQ ID NO: 1601 - DNA, 47 bp, Homo Sapiens
  allele 24: 99-5032-232 : polymorphic base A or C
ggactcaaagcaggcccgggagcmagtgggcagaagacccttgacgc

SEQ ID NO: 1602 - DNA, 47 bp, Homo Sapiens
  allele 24: 99-5036-40 : polymorphic base C or T
ggtaagtatattgcctccccaaayatataggtcttaaaggacattaa

SEQ ID NO: 1603 - DNA, 47 bp, Homo Sapiens
  allele 24: 99-5038-181 : polymorphic base C or T
cacttgacagtccccagaccaggycctgcccccgcacaaagtgctca

SEQ ID NO: 1604 - DNA, 47 bp, Homo Sapiens
  allele 24: 99-5043-111 : polymorphic base A or C
aagaaacctccaatttacaggagmcacaggacccacctccaacacct

SEQ ID NO: 1605 - DNA, 47 bp, Homo Sapiens
  allele 24: 99-5099-245 : polymorphic base A or G
agaaaggcatgtcttacatggcartaggcaagaaagaaaaagaaaca

SEQ ID NO: 1606 - DNA, 47 bp, Homo Sapiens
  allele 24: 99-5101-284 : polymorphic base G or T
tacttggataatctttcaagaaakttggcccaggatgaaagaaaaga

SEQ ID NO: 1607 - DNA, 47 bp, Homo Sapiens
  allele 24: 99-5104-160 : polymorphic base A or G
agtttcaaatgaaactagatctcractgcttactgcagccttgactt

SEQ ID NO: 1608 - DNA, 47 bp, Homo Sapiens
  allele 24: 99-5107-184 : polymorphic base G or T
accccctggattctgatcctgtckccttactgaggtcgatgggcctc

SEQ ID NO: 1609 - DNA, 47 bp, Homo Sapiens
  allele 24: 99-5108-144 : polymorphic base A or G
cacaggactaggaggaagctagarctcaccccatataacatttcctt

SEQ ID NO: 1610 - DNA, 47 bp, Homo Sapiens
  allele 24: 99-511-33 : polymorphic base C or T
ctcgaacccacagacttcattccyacacttctggacctgttcaagat

SEQ ID NO: 1611 - DNA, 47 bp, Homo Sapiens
  allele 24: 99-5130-355 : polymorphic base C or T
ggcttttaaaattgcccgtaagtycctattttctcaattagtgtttt

SEQ ID NO: 1612 - DNA, 47 bp, Homo Sapiens
  allele 24: 99-5142-74 : polymorphic base C or T
agaatcgatccttaatcaatattyggtgagtattatgaatagggtac

SEQ ID NO: 1613 - DNA, 47 bp, Homo Sapiens
  allele 24: 99-5148-269 : polymorphic base G or C
cattcaggtgatgaatgtttgcascctgtctggtacccatcttgtcc

SEQ ID NO: 1614 - DNA, 47 bp, Homo Sapiens
  allele 24: 99-5149-436 : polymorphic base C or T
tatgggtcagatctggaaagttayaaaaaggtgcaaaccatcagggt

SEQ ID NO: 1615 - DNA, 47 bp, Homo Sapiens
  allele 24: 99-5157-422 : polymorphic base G or C
tattttagggtcctctgaccatgscctgaatgcagcatgtctttctt

SEQ ID NO: 1616 - DNA, 47 bp, Homo Sapiens
  allele 24: 99-5162-461 : polymorphic base C or T
gagtaggataaacctcagcctgaytcacagatggattattgcaatat

SEQ ID NO: 1617 - DNA, 47 bp, Homo Sapiens
  allele 24: 99-5168-220 : polymorphic base C or T
aatggtgctggtgggctgtgctaygtaggatcatgcttgctgagttc

SEQ ID NO: 1618 - DNA, 47 bp, Homo Sapiens
  allele 24: 99-5184-146 : polymorphic base A or G
tatgtaggaatacgatttgaaggrctctgaccttccagtggcaacac

SEQ ID NO: 1619 - DNA, 47 bp, Homo Sapiens
  allele 24: 99-5186-455 : polymorphic base A or G
aaaataatcagattctatcctaartaagcagatccctacccagcagg

SEQ ID NO: 1620 - DNA, 47 bp, Homo Sapiens
  allele 24: 99-5189-412 : polymorphic base C or T
tgcaaatgtagttgtgatgcagtyccagtaagttttagctacaaaag

SEQ ID NO: 1621 - DNA, 47 bp, Homo Sapiens
  allele 24: 99-5193-430 : polymorphic base A or G
gaaatcagatgaaagaattgatcrtaaaggaaagggaacccactgga

SEQ ID NO: 1622 - DNA, 47 bp, Homo Sapiens
  allele 24: 99-5194-145 : polymorphic base A or G
tcctttataatgtggccctgcctrcttctctagtgttctcccactct

SEQ ID NO: 1623 - DNA, 47 bp, Homo Sapiens
  allele 24: 99-5199-108 : polymorphic base A or T
atacatttggataatcctatacawaatataatggtgctaagtttata

SEQ ID NO: 1624 - DNA, 47 bp, Homo Sapiens
  allele 24: 99-5202-145 : polymorphic base A or G
agaaaatgttgctttagtgcctartgtcccagagccaatttagaacc

SEQ ID NO: 1625 - DNA, 47 bp, Homo Sapiens
  allele 24: 99-5224-293 : polymorphic base G or C
tatgggatgtagtgaaagaagtcstacaagggaaatttatagtgaca

SEQ ID NO: 1626 - DNA, 47 bp, Homo Sapiens
  allele 24: 99-5225-198 : polymorphic base C or T
ttcctgcccacaaggggttccagyaggagagacttctagtgtaaata

SEQ ID NO: 1627 - DNA, 47 bp, Homo Sapiens
  allele 24: 99-5226-215 : polymorphic base A or G
taaggtgaccatgaagtccacaarttgaaatgtcagagccacagttt

SEQ ID NO: 1628 - DNA, 47 bp, Homo Sapiens
  allele 24: 99-5247-158 : polymorphic base A or G
tggacctggaaagacaagagaagraaattgaaaagtaacaattcata

SEQ ID NO: 1629 - DNA, 47 bp, Homo Sapiens
  allele 24: 99-5252-252 : polymorphic base A or G
tttggtccaatctaaggtagctargcaacaaaaccttgctttgtaga

SEQ ID NO: 1630 - DNA, 47 bp, Homo Sapiens
  allele 24: 99-5265-288 : polymorphic base C or T
cctcagagccctcacttgctctcygcacctcctctgcctgggctccc

SEQ ID NO: 1631 - DNA, 47 bp, Homo Sapiens
  allele 24: 99-5290-322 : polymorphic base C or T
cctaaaagtctccagttaattatyacctcctctaagtttcctccagc

SEQ ID NO: 1632 - DNA, 47 bp, Homo Sapiens
  allele 24: 99-5291-331 : polymorphic base A or C
ctgtgtaaaagtaaaatgtaaaamatccacagcataaaggttgtcgg

SEQ ID NO: 1633 - DNA, 47 bp, Homo Sapiens
  allele 24: 99-5294-362 : polymorphic base A or C
ctcttcagatatgttctcttgggmagtcacatcctggggacttcaag

SEQ ID NO: 1634 - DNA, 47 bp, Homo Sapiens
  allele 24: 99-5306-93 : polymorphic base C or T
cccatcctcctctctgccccagcycctacagagagggttgatctcta

SEQ ID NO: 1635 - DNA, 47 bp, Homo Sapiens
  allele 24: 99-5308-341 : polymorphic base G or C
tgcgggttttctccttgaacctasaagattatgggtcaagagctgtg

SEQ ID NO: 1636 - DNA, 47 bp, Homo Sapiens
  allele 24: 99-5312-273 : polymorphic base C or T
ggtagattgtcgacaatggtgctycagtattctcggcctgggggagc

SEQ ID NO: 1637 - DNA, 47 bp, Homo Sapiens
  allele 24: 99-5326-332 : polymorphic base A or G
tgattttttggtactgtagaatgraaagtgtttatatttacaaattt

SEQ ID NO: 1638 - DNA, 47 bp, Homo Sapiens
  allele 24: 99-5338-151 : polymorphic base C or T
caatgtctaaatagttccttcctytcaccaccaaacttaaatctgtg

SEQ ID NO: 1639 - DNA, 47 bp, Homo Sapiens
  allele 24: 99-5355-165 : polymorphic base A or G
gcttgcattcagaggtgtcatagragagccccctggggcctgtgctg

SEQ ID NO: 1640 - DNA, 47 bp, Homo Sapiens
  allele 24: 99-5356-100 : polymorphic base A or T
cctgtgaagccatcacaaggagcwagagcacaggcttaaggaaatgg

SEQ ID NO: 1641 - DNA, 47 bp, Homo Sapiens
  allele 24: 99-5360-151 : polymorphic base C or T
gttccttcagctacctgcccatcygcccactcccctcgaacctcagc

SEQ ID NO: 1642 - DNA, 47 bp, Homo Sapiens
  allele 24: 99-5362-203 : polymorphic base C or T
aatgcagcccagtaggtttcagcytcattttacccagcccctattca

SEQ ID NO: 1643 - DNA, 47 bp, Homo Sapiens
  allele 24: 99-5364-95 : polymorphic base C or T
  misc_feature 47: n=a, g, c or t
atcatgaatgaattgatcacttaygtgtatttaaatataatggcaan

SEQ ID NO: 1644 - DNA, 47 bp, Homo Sapiens
  allele 24: 99-5379-158 : polymorphic base A or G
gaaaactgagtgaagactgagagraattcacagcatgggatttggga

SEQ ID NO: 1645 - DNA, 47 bp, Homo Sapiens
  allele 24: 99-5386-85 : polymorphic base A or G
ctcccttccttctgaaagactgcrtcaaaataataggcagttcttgg

SEQ ID NO: 1646 - DNA, 47 bp, Homo Sapiens
  allele 24: 99-5389-409 : polymorphic base A or G
acattgtcctggagatgatgaagracccctgagagttttaagcagag

SEQ ID NO: 1647 - DNA, 47 bp, Homo Sapiens
  allele 24: 99-5390-375 : polymorphic base C or T
agccttgctggtggggaggcctgytctgagcctctggggttgttgga

SEQ ID NO: 1648 - DNA, 47 bp, Homo Sapiens
  allele 24: 99-5401-280 : polymorphic base C or T
ctgcaattgcaatcctgcctcacyctctccaagctgggagaatgggg

SEQ ID NO: 1649 - DNA, 47 bp, Homo Sapiens
  allele 24: 99-5405-376 : polymorphic base C or T
gggcaccatgttgttagaccactygtagtgtggttggccatgtttct

SEQ ID NO: 1650 - DNA, 47 bp, Homo Sapiens
  allele 24: 99-5406-299 : polymorphic base A or T
atagtggctatagtgacagttatwtatttgagggaaacttatctata

SEQ ID NO: 1651 - DNA, 47 bp, Homo Sapiens
  allele 24: 99-5407-173 : polymorphic base C or T
aatcgtctcatgatttttaagttyctgaacagccgaacgattgttga

SEQ ID NO: 1652 - DNA, 47 bp, Homo Sapiens
  allele 24: 99-5411-378 : polymorphic base C or T
acgaaggtgaccccacccagcatytaccctgtgtccctatcttggac

SEQ ID NO: 1653 - DNA, 47 bp, Homo Sapiens
  allele 24: 99-5416-137 : polymorphic base A or G
ggcagatgcgaacgctccgaaggrcgcccctctgcagctggctgacc

SEQ ID NO: 1654 - DNA, 47 bp, Homo Sapiens
  allele 24: 99-5420-425 : polymorphic base G or C
aaaaaagggtgtcttgtgacatgsccagataactggtggctatagtt

SEQ ID NO: 1655 - DNA, 47 bp, Homo Sapiens
  allele 24: 99-5427-466 : polymorphic base A or G
agtgcttaaatcaattggagtaarttctactgagttctttttcaaga

SEQ ID NO: 1656 - DNA, 47 bp, Homo Sapiens
  allele 24: 99-5432-391 : polymorphic base G or C
tcagtgtctactggggaccccttstttttctactgtgaacagaaagc

SEQ ID NO: 1657 - DNA, 47 bp, Homo Sapiens
  allele 24: 99-5433-45 : polymorphic base C or T
tttttaattttgccccggtcctgygatcttgccctgcctcaatttgc

SEQ ID NO: 1658 - DNA, 47 bp, Homo Sapiens
  allele 24: 99-5437-159 : polymorphic base A or G
cagtttgtgtgtgtcctattaaartataataaaataagtggctctgg

SEQ ID NO: 1659 - DNA, 47 bp, Homo Sapiens
  allele 24: 99-5438-70 : polymorphic base C or T
ttggattctgagaaaaatccacayaggtgattataattgaaaagtag

SEQ ID NO: 1660 - DNA, 47 bp, Homo Sapiens
  allele 24: 99-5441-287 : polymorphic base C or T
catttgtttagaagattattcttycctccattgaaattgtcttggca

SEQ ID NO: 1661 - DNA, 47 bp, Homo Sapiens
  allele 24: 99-5446-303 : polymorphic base C or T
atagatttttctaatctcccataytcccacaaccataaatgacaaaa

SEQ ID NO: 1662 - DNA, 47 bp, Homo Sapiens
  allele 24: 99-5447-322 : polymorphic base A or G
agaggtttgatcagatttaggtgraattataaaaagattccgtcata

SEQ ID NO: 1663 - DNA, 47 bp, Homo Sapiens
  allele 24: 99-5458-203 : polymorphic base C or T
gaaggacatactgcctgtgaatcytgtatcttcatgtgagtcagctt

SEQ ID NO: 1664 - DNA, 47 bp, Homo Sapiens
  allele 24: 99-5468-319 : polymorphic base A or C
taggagctttctcagtgtactgcmggctttgctgacagactgtttat

SEQ ID NO: 1665 - DNA, 47 bp, Homo Sapiens
  allele 24: 99-5472-290 : polymorphic base C or T
actgaccttctctctgaccttgtycattccattcccagctcctggcc

SEQ ID NO: 1666 - DNA, 47 bp, Homo Sapiens
  allele 24: 99-5475-455 : polymorphic base A or G
gccctttggttgacctcacccagrttttatctccctgctacttttca

SEQ ID NO: 1667 - DNA, 47 bp, Homo Sapiens
  allele 24: 99-5477-207 : polymorphic base A or C
taaagccagcatgttgcttgaggmaagatgtttgatatacttttcct

SEQ ID NO: 1668 - DNA, 47 bp, Homo Sapiens
  allele 24: 99-5485-325 : polymorphic base A or G
tcggagtaggaggcaaccaggaaraattttagggtctgaattattag

SEQ ID NO: 1669 - DNA, 47 bp, Homo Sapiens
  allele 24: 99-5490-368 : polymorphic base C or T
ccactggcatacactgctattcayattgagaatgataatttccacgg

SEQ ID NO: 1670 - DNA, 47 bp, Homo Sapiens
  allele 24: 99-5494-205 : polymorphic base A or G
gaaaccttgtgcctgttgataggrcttttgatgaaagcctgggaaag

SEQ ID NO: 1671 - DNA, 47 bp, Homo Sapiens
  allele 24: 99-5502-433 : polymorphic base A or C
cttgttggagctgaggcatccatmttctgccctcagacattggcact

SEQ ID NO: 1672 - DNA, 47 bp, Homo Sapiens
  allele 24: 99-5505-226 : polymorphic base C or T
tttctgtcacccattcctcctacytaactgtaacttatcactttctt

SEQ ID NO: 1673 - DNA, 47 bp, Homo Sapiens
  allele 24: 99-5516-121 : polymorphic base C or T
taatctagtttccgagaatagaayctgtgtttacccgggatcactag

SEQ ID NO: 1674 - DNA, 47 bp, Homo Sapiens
  allele 24: 99-5526-334 : polymorphic base C or T
tttgctgcatgctgactcctatgytgaacccataagagtcaagtgat

SEQ ID NO: 1675 - DNA, 47 bp, Homo Sapiens
  allele 24: 99-5566-131 : polymorphic base A or G
atactgagatgcattctaagtctrcaggtcaaacctattacaacaat

SEQ ID NO: 1676 - DNA, 47 bp, Homo Sapiens
  allele 24: 99-5582-71 : polymorphic base G or C
gagcagagttttaaaataagcccsatttgcccctacagatctcctgc

SEQ ID NO: 1677 - DNA, 47 bp, Homo Sapiens
  allele 24: 99-5590-99 : polymorphic base C or T
gcatatgatattgaataaatataytgttattcaacgttcatttaaca

SEQ ID NO: 1678 - DNA, 47 bp, Homo Sapiens
  allele 24: 99-5595-380 : polymorphic base A or G
ttcttaatcttttgatttgggaargtggagacaagcttcaaaaatga

SEQ ID NO: 1679 - DNA, 47 bp, Homo Sapiens
  allele 24: 99-5596-216 : polymorphic base A or G
cagcacatgatttgttctcaggtrtttattgggtgttaaagtgatgt

SEQ ID NO: 1680 - DNA, 47 bp, Homo Sapiens
  allele 24: 99-5604-376 : polymorphic base A or G
atttcctgttattgctatagtacrtcatgctgtttgaatattgttaa

SEQ ID NO: 1681 - DNA, 47 bp, Homo Sapiens
  allele 24: 99-5608-324 : polymorphic base A or G
tcagctgacacaaagtaagacgcrttagattggggttatcatacaat

SEQ ID NO: 1682 - DNA, 47 bp, Homo Sapiens
  allele 24: 99-5632-425 : polymorphic base A or G
agacagtaaaactgaagatacccrgaatatttataacatatgtttgc

SEQ ID NO: 1683 - DNA, 47 bp, Homo Sapiens
  allele 24: 99-5633-334 : polymorphic base A or G
catatggtaaaaatctaagaatarcatcataaatcatccatgcctct

SEQ ID NO: 1684 - DNA, 47 bp, Homo Sapiens
  allele 24: 99-5634-426 : polymorphic base C or T
gtggggtctggctaggctggaggyagcacatgagccgcagatggatg

SEQ ID NO: 1685 - DNA, 47 bp, Homo Sapiens
  allele 24: 99-5636-198 : polymorphic base C or T
gagttcctggaaggagccagaggygtggagaggcagactttcctgta

SEQ ID NO: 1686 - DNA, 47 bp, Homo Sapiens
  allele 24: 99-5660-265 : polymorphic base G or C
agtcattgtgactgatggcatcascacccattgctgaactataggaa

SEQ ID NO: 1687 - DNA, 47 bp, Homo Sapiens
  allele 24: 99-5670-264 : polymorphic base C or T
cacaagggctggacaggacattcyagttattgtgagggttttaaaac

SEQ ID NO: 1688 - DNA, 47 bp, Homo Sapiens
  allele 24: 99-5678-321 : polymorphic base A or G
tcctgtattcaccacaggtaactrgtgcctggccagcgctataggca

SEQ ID NO: 1689 - DNA, 47 bp, Homo Sapiens
  allele 24: 99-5680-109 : polymorphic base A or G
tgtaacagttactacacaaaaacrgccataatatgtcagcagcatat

SEQ ID NO: 1690 - DNA, 47 bp, Homo Sapiens
  allele 24: 99-5681-81 : polymorphic base C or T
aagcagcagcagcttcagccatcycctgggccagacaggcatttcct

SEQ ID NO: 1691 - DNA, 47 bp, Homo Sapiens
  allele 24: 99-5685-274 : polymorphic base A or T
ataaaaccatagggcataaaccawtgcttggctctttctttctgccc

SEQ ID NO: 1692 - DNA, 47 bp, Homo Sapiens
  allele 24: 99-5686-274 : polymorphic base G or C
ggcaggcacacgacatttgaatastagagaggcacagcattctaaca

SEQ ID NO: 1693 - DNA, 47 bp, Homo Sapiens
  allele 24: 99-5700-142 : polymorphic base G or C
tcttctggtgatgctgtgagcgcstgatccactcagcaaatatttat

SEQ ID NO: 1694 - DNA, 47 bp, Homo Sapiens
  allele 24: 99-5702-192 : polymorphic base C or T
cacttttcacactttattgcatcyaatcctcaccacaacactctgag

SEQ ID NO: 1695 - DNA, 47 bp, Homo Sapiens
  allele 24: 99-5703-72 : polymorphic base C or T
ggaaggaaaaggaatatcagagcyacatctctgaggctctgatacta

SEQ ID NO: 1696 - DNA, 47 bp, Homo Sapiens
  allele 24: 99-5709-80 : polymorphic base A or G
ctagcagaactggatcatgaatcracaaaatgaaggaggctttgcaa

SEQ ID NO: 1697 - DNA, 47 bp, Homo Sapiens
  allele 24: 99-5711-206 : polymorphic base C or T
ccgccccctgatcagaagctgcgygtctccaattagtcgcccaggtg

SEQ ID NO: 1698 - DNA, 47 bp, Homo Sapiens
  allele 24: 99-5712-123 : polymorphic base A or T
tcaggcactgcaaagtcttcaagwctcaatatggctttatttcttag

SEQ ID NO: 1699 - DNA, 47 bp, Homo Sapiens
  allele 24: 99-5727-77 : polymorphic base C or T
atcattatggatagagctacaaayttggctagatagcattttccttt

SEQ ID NO: 1700 - DNA, 47 bp, Homo Sapiens
  allele 24: 99-5729-370 : polymorphic base A or G
cagttcatccacaaattctttatrtatatatggataaaatctaaaca

SEQ ID NO: 1701 - DNA, 47 bp, Homo Sapiens
  allele 24: 99-5731-450 : polymorphic base G or T
tatgatggtatttgcaggtagagkctttgggaaatagttaggtttag

SEQ ID NO: 1702 - DNA, 47 bp, Homo Sapiens
  allele 24: 99-5741-59 : polymorphic base A or G
aaaactccccaatggtcttcaatrccatattaaaaggattttaatac

SEQ ID NO: 1703 - DNA, 47 bp, Homo Sapiens
  allele 24: 99-5742-337 : polymorphic base C or T
tgggcacaggccagcgtttcctcycatcttctcatttctctcagact

SEQ ID NO: 1704 - DNA, 47 bp, Homo Sapiens
  allele 24: 99-5745-256 : polymorphic base G or C
gagatcagtagggcagacgggggsgaaatatgccccataagaacaaa

SEQ ID NO: 1705 - DNA, 47 bp, Homo Sapiens
  allele 24: 99-5756-233 : polymorphic base A or G
ccagaccctgctctaacaactagraagacagcaattctttcccatgg

SEQ ID NO: 1706 - DNA, 47 bp, Homo Sapiens
  allele 24: 99-576-421 : polymorphic base G or C
tgcaaaaactatcttagttgaagsatagttcatgttacatgagtaaa

SEQ ID NO: 1707 - DNA, 47 bp, Homo Sapiens
  allele 24: 99-5760-164 : polymorphic base A or G
ctaatgggagaatcacatggcctrcctgtgagtcaggccagcttctg

SEQ ID NO: 1708 - DNA, 47 bp, Homo Sapiens
  allele 24: 99-5770-275 : polymorphic base C or T
atatgaaaaactgacacagaaaayaattaagggaaagttggtaaaat

SEQ ID NO: 1709 - DNA, 47 bp, Homo Sapiens
  allele 24: 99-5781-110 : polymorphic base G or C
aatacaaggtagtcttgagccttscaacacgtgtgaattttgtgtct

SEQ ID NO: 1710 - DNA, 47 bp, Homo Sapiens
  allele 24: 99-5795-234 : polymorphic base A or C
aaatgtctcattatttttctagtmttttattttcaaatcttcagcag

SEQ ID NO: 1711 - DNA, 47 bp, Homo Sapiens
  allele 24: 99-5813-34 : polymorphic base A or T
ccattcctctctacataactgtcwttcagtacagctgttatctatag

SEQ ID NO: 1712 - DNA, 47 bp, Homo Sapiens
  allele 24: 99-582-132 : polymorphic base A or G
aaatataccgggtaaatgtaatgraggaaaaaagtacacttaaccta

SEQ ID NO: 1713 - DNA, 47 bp, Homo Sapiens
  allele 24: 99-5832-136 : polymorphic base C or T
caggtagaaggcattttaattaayatgtggattaaaatacctataaa

SEQ ID NO: 1714 - DNA, 47 bp, Homo Sapiens
  allele 24: 99-5836-327 : polymorphic base C or T
cttccacttaccctttaaaactgygaacttagtcttcatatttatcc

SEQ ID NO: 1715 - DNA, 47 bp, Homo Sapiens
  allele 24: 99-5837-407 : polymorphic base C or T
atgccctctaatactctttgcaayatgaagttctttggttgtttcaa

SEQ ID NO: 1716 - DNA, 47 bp, Homo Sapiens
  allele 24: 99-5860-278 : polymorphic base A or G
aagcttcttcctctgaggagagcrtctcgtgggttcttgggctcttt

SEQ ID NO: 1717 - DNA, 47 bp, Homo Sapiens
  allele 24: 99-5867-284 : polymorphic base G or T
aaactactattctggctgccttgkttagaattaaatgaagagagaaa

SEQ ID NO: 1718 - DNA, 47 bp, Homo Sapiens
  allele 24: 99-5875-411 : polymorphic base A or G
tatttaatgggattctactatggracatgaactatactgagaatata

SEQ ID NO: 1719 - DNA, 47 bp, Homo Sapiens
  allele 24: 99-5893-211 : polymorphic base A or G
ctgttaattcaaagagatactacraacgcgcgcaaaatagattttat

SEQ ID NO: 1720 - DNA, 47 bp, Homo Sapiens
  allele 24: 99-5907-143 : polymorphic base C or T
aggagagccacaatataaagctaytaccctcttcataaacattggga

SEQ ID NO: 1721 - DNA, 47 bp, Homo Sapiens
  allele 24: 99-5908-225 : polymorphic base A or G
gatggcggagagaaccaatagcargctatgcaaagactaataataaa

SEQ ID NO: 1722 - DNA, 47 bp, Homo Sapiens
  allele 24: 99-5909-292 : polymorphic base C or T
ccccaaactaacagtctagacaaygcatgttgtagatattataagaa

SEQ ID NO: 1723 - DNA, 47 bp, Homo Sapiens
  allele 24: 99-5912-49 : polymorphic base A or G
cattaggacacattaaaaatgtcraattaccttgggaccttatatga

SEQ ID NO: 1724 - DNA, 47 bp, Homo Sapiens
  allele 24: 99-5915-378 : polymorphic base A or G
cagagaaaaagaagttgtatacarattccaaataataatttgacact

SEQ ID NO: 1725 - DNA, 47 bp, Homo Sapiens
  allele 24: 99-5951-438 : polymorphic base C or T
agagttataattaatggtgctaayttataaagagagatggggagcca

SEQ ID NO: 1726 - DNA, 47 bp, Homo Sapiens
  allele 24: 99-5957-123 : polymorphic base G or C
tacatctaaaaacattgccaaatscagatattgatctctaacatttt

SEQ ID NO: 1727 - DNA, 47 bp, Homo Sapiens
  allele 24: 99-596-228 : polymorphic base G or C
actaacccaaaagtctaaggaaasatggaaaactcaaaggagaaaca

SEQ ID NO: 1728 - DNA, 47 bp, Homo Sapiens
  allele 24: 99-5968-382 : polymorphic base A or T
cagctgccaaacccaaacttgccwtgctgcctaaagtccaacaatta

SEQ ID NO: 1729 - DNA, 47 bp, Homo Sapiens
  allele 24: 99-5979-96 : polymorphic base C or T
acaaggagaaaaagccaaatacayaattacagttgaagactcaatag

SEQ ID NO: 1730 - DNA, 47 bp, Homo Sapiens
  allele 24: 99-598-130 : polymorphic base A or G
tcatgggggcaaaaaagcaagggrccactgtgcataggatgccaaca

SEQ ID NO: 1731 - DNA, 47 bp, Homo Sapiens
  allele 24: 99-6007-246 : polymorphic base A or C
acagttgacaatcttacccaaacmccctttgcatcctgctgcagcag

SEQ ID NO: 1732 - DNA, 47 bp, Homo Sapiens
  allele 24: 99-6012-220 : polymorphic base G or T
tgattttagagatttctttatcckaattttgaagactttctttcaca

SEQ ID NO: 1733 - DNA, 47 bp, Homo Sapiens
  allele 24: 99-602-258 : polymorphic base A or G
ttgaaagtaaatggctacaaactrtctcctgatgagaaagaaaacat

SEQ ID NO: 1734 - DNA, 47 bp, Homo Sapiens
  allele 24: 99-6038-286 : polymorphic base A or G
cctttgcacttaaaattcgatgaratacatattctccattgactata

SEQ ID NO: 1735 - DNA, 47 bp, Homo Sapiens
  allele 24: 99-6042-134 : polymorphic base G or C
tcttaaatcttctcttacttactsatacactttttgggatatgcatt

SEQ ID NO: 1736 - DNA, 47 bp, Homo Sapiens
  allele 24: 99-6051-251 : polymorphic base G or C
aaaccctaaatgccttttgtctgsctatttcctatgcatccttcaag

SEQ ID NO: 1737 - DNA, 47 bp, Homo Sapiens
  allele 24: 99-6067-247 : polymorphic base C or T
aggtaaaagcccatgcttacatayctggctctatctcacctagtgga

SEQ ID NO: 1738 - DNA, 47 bp, Homo Sapiens
  allele 24: 99-6069-41 : polymorphic base A or G
caaacaatccaaacaccttctacrtattcattcttagaccagaatcc

SEQ ID NO: 1739 - DNA, 47 bp, Homo Sapiens
  allele 24: 99-607-397 : polymorphic base A or G
tcacctaaagtatatactgcactrttttgaagaccagttctctgcaa

SEQ ID NO: 1740 - DNA, 47 bp, Homo Sapiens
  allele 24: 99-6077-346 : polymorphic base C or T
ccaaagtttttttttctggcatcygtctgcctctcctatacttctcc

SEQ ID NO: 1741 - DNA, 47 bp, Homo Sapiens
  allele 24: 99-6079-343 : polymorphic base A or G
aatacctgggttcaaaggtcagcrcttacaaaggcatcttgacaagc

SEQ ID NO: 1742 - DNA, 47 bp, Homo Sapiens
  allele 24: 99-608-183 : polymorphic base G or T
tgtgccatctgtagaaaaacctakgtttcatgcaaatgaaatacaaa

SEQ ID NO: 1743 - DNA, 47 bp, Homo Sapiens
  allele 24: 99-6080-99 : polymorphic base C or T
tctctagcaatttaatacaattaygaaatggaaaagttggcaaatgc

SEQ ID NO: 1744 - DNA, 47 bp, Homo Sapiens
  allele 24: 99-609-225 : polymorphic base A or T
agtaaccctggaggcctgttgggwacatgggcagtgtcgcggctgag

SEQ ID NO: 1745 - DNA, 47 bp, Homo Sapiens
  allele 24: 99-6091-305 : polymorphic base A or G
aaactacacaagtaaacaaagccrcatttaatgatggaggcctattt

SEQ ID NO: 1746 - DNA, 47 bp, Homo Sapiens
  allele 24: 99-6094-223 : polymorphic base C or T
ttaaatcatagctttggaaacacygaacttcttgagtaaaggcagga

SEQ ID NO: 1747 - DNA, 47 bp, Homo Sapiens
  allele 24: 99-6095-316 : polymorphic base A or G
aactttaatttcaaaaaattcttraatgaagatatagagaaaggaag

SEQ ID NO: 1748 - DNA, 47 bp, Homo Sapiens
  allele 24: 99-6097-202 : polymorphic base G or T
ctttataataacttagatgaccakgttagaacttctggactccttgg

SEQ ID NO: 1749 - DNA, 47 bp, Homo Sapiens
  allele 24: 99-610-250 : polymorphic base A or G
ttaagtaattttaagttcattatrattgcttgttcatgataatttca

SEQ ID NO: 1750 - DNA, 47 bp, Homo Sapiens
  allele 24: 99-6112-275 : polymorphic base C or T
agtattataaaatatttgaaaagyacctgcctgcctatagatctttg

SEQ ID NO: 1751 - DNA, 47 bp, Homo Sapiens
  allele 24: 99-6117-221 : polymorphic base A or G
gagccccacttcagacctgctgartcagaatctgtggattaacagaa

SEQ ID NO: 1752 - DNA, 47 bp, Homo Sapiens
  allele 24: 99-6122-100 : polymorphic base A or G
gatttgtctgttattttacctctrtgcagaggttttgtggacctaag

SEQ ID NO: 1753 - DNA, 47 bp, Homo Sapiens
  allele 24: 99-6131-166 : polymorphic base A or G
gcaaagatggacttacttggatarttacaacatgtatatattttgtc

SEQ ID NO: 1754 - DNA, 47 bp, Homo Sapiens
  allele 24: 99-6135-319 : polymorphic base C or T
tgcccttctccacacggatgaccyctgtcccataggatagcgaccac

SEQ ID NO: 1755 - DNA, 47 bp, Homo Sapiens
  allele 24: 99-614-346 : polymorphic base G or C
gttttcattacctttaaaaataasccatgtaacatcataaggaaaac

SEQ ID NO: 1756 - DNA, 47 bp, Homo Sapiens
  allele 24: 99-6141-339 : polymorphic base C or T
agaaacctgccaactaaatgtaaygcatggtcctagattggatcttg

SEQ ID NO: 1757 - DNA, 47 bp, Homo Sapiens
  allele 24: 99-615-387 : polymorphic base A or C
tgtcctgtaatagtgatgattccmgaatgatgctattagcttgtgct

SEQ ID NO: 1758 - DNA, 47 bp, Homo Sapiens
  allele 24: 99-616-338 : polymorphic base A or G
taagaatgtcttgtgaaatttgtraaaatactagtagtgggctatcc

SEQ ID NO: 1759 - DNA, 47 bp, Homo Sapiens
  allele 24: 99-6176-96 : polymorphic base A or G
gaatgtacagataatgtcactctrgtactaaatttagcaaataaaat

SEQ ID NO: 1760 - DNA, 47 bp, Homo Sapiens
  allele 24: 99-6180-389 : polymorphic base G or T
ataaacagtctgtcagcaaagcckgcagtacactgagaaagctccta

SEQ ID NO: 1761 - DNA, 47 bp, Homo Sapiens
  allele 24: 99-6181-328 : polymorphic base A or C
atttcaacttttctagataatggmaaattgttttccagttattgtgt

SEQ ID NO: 1762 - DNA, 47 bp, Homo Sapiens
  allele 24: 99-6189-224 : polymorphic base A or G
tttgcactaagactggaaattggrgttactatcctatatagatgctg

SEQ ID NO: 1763 - DNA, 47 bp, Homo Sapiens
  allele 24: 99-619-141 : polymorphic base C or T
tacattgtctatcaaacattgtaycccttggtacccaggacagcacc

SEQ ID NO: 1764 - DNA, 47 bp, Homo Sapiens
  allele 24: 99-6191-252 : polymorphic base A or C
aaattcaaatgctgttaacagccmtatttactgctttactgagaaac

SEQ ID NO: 1765 - DNA, 47 bp, Homo Sapiens
  allele 24: 99-6193-88 : polymorphic base C or T
gttagtcctgaaataaattttgcytcagggctttggcacttgatgtt

SEQ ID NO: 1766 - DNA, 47 bp, Homo Sapiens
  allele 24: 99-621-215 : polymorphic base A or G
gttatatcacctttaatttatcargatttcagttatttccatatata

SEQ ID NO: 1767 - DNA, 47 bp, Homo Sapiens
  allele 24: 99-6217-420 : polymorphic base C or T
atatttaaaaaccagtcacaagaygagccagcaaaggaagttcagga

SEQ ID NO: 1768 - DNA, 47 bp, Homo Sapiens
  allele 24: 99-622-95 : polymorphic base A or G
accacttattttttaaacctagarttgaaaggtgtaaaaatgtcatt

SEQ ID NO: 1769 - DNA, 47 bp, Homo Sapiens
  allele 24: 99-6253-308 : polymorphic base C or T
tctcttgtcctggtaacatggttyattccacatgggatccttcctcc

SEQ ID NO: 1770 - DNA, 47 bp, Homo Sapiens
  allele 24: 99-6257-226 : polymorphic base C or T
caagggggtaggaaatgagagcayggttggccattgaccttttggtc

SEQ ID NO: 1771 - DNA, 47 bp, Homo Sapiens
  allele 24: 99-6261-172 : polymorphic base A or C
aattgccaagcccaacagtctacmcacggggtcaacaaaccttgtcc

SEQ ID NO: 1772 - DNA, 47 bp, Homo Sapiens
  allele 24: 99-6278-391 : polymorphic base C or T
gcatgcatgtgcacaagtgcacayacaacctccacccctactccctg

SEQ ID NO: 1773 - DNA, 47 bp, Homo Sapiens
  allele 24: 99-6294-184 : polymorphic base C or T
ccttcctcttattcatatttcagyctacagaaagttaaaagaagtca

SEQ ID NO: 1774 - DNA, 47 bp, Homo Sapiens
  allele 24: 99-6298-280 : polymorphic base A or C
gattcctgggacgtactgcatcamtctctgtgaggtggggcttagca

SEQ ID NO: 1775 - DNA, 47 bp, Homo Sapiens
  allele 24: 99-6300-106 : polymorphic base G or C
agaaatgttgggggaaggagattstattgagaaagtgtgctagaaac

SEQ ID NO: 1776 - DNA, 47 bp, Homo Sapiens
  allele 24: 99-6310-217 : polymorphic base G or C
ccacgtatggtatgagagggtgasaagccattggagtgtctgtttgg

SEQ ID NO: 1777 - DNA, 47 bp, Homo Sapiens
  allele 24: 99-632-173 : polymorphic base C or T
ctttaatatgaagtacttttgccyatgttacttccttcaggacatct

SEQ ID NO: 1778 - DNA, 47 bp, Homo Sapiens
  allele 24: 99-6327-270 : polymorphic base A or C
ccagctctatagggagcactcttmctttacacaagcatttttttctt

SEQ ID NO: 1779 - DNA, 47 bp, Homo Sapiens
  allele 24: 99-6332-143 : polymorphic base C or T
gaagttacaataaagcagaaccayatcaagactggggtgtaaccagt

SEQ ID NO: 1780 - DNA, 47 bp, Homo Sapiens
  allele 24: 99-6367-268 : polymorphic base A or C
aaccagctttgtgctctaccccamtgttaccaagctggtatctaagc

SEQ ID NO: 1781 - DNA, 47 bp, Homo Sapiens
  allele 24: 99-6368-426 : polymorphic base A or G
gcagagggaaggaatctctgcaaragctttgagctatgctgactgtg

SEQ ID NO: 1782 - DNA, 47 bp, Homo Sapiens
  allele 24: 99-6404-147 : polymorphic base A or G
ctcctgccaccctgaggttgcatrggggcctgaggacagagctattt

SEQ ID NO: 1783 - DNA, 47 bp, Homo Sapiens
  allele 24: 99-6409-62 : polymorphic base C or T
  misc_feature 25: n=a, g, c or t
cagctcagatgtgagagaggctcynagagagccgaggcaggccatgg

SEQ ID NO: 1784 - DNA, 47 bp, Homo Sapiens
  allele 24: 99-6411-93 : polymorphic base A or G
tgaatggtgtcccccagatttctrtgttgaagccctaaccctagtat

SEQ ID NO: 1785 - DNA, 47 bp, Homo Sapiens
  allele 24: 99-6413-369 : polymorphic base C or T
ggctcaggagagggctccaggacytgaccccagcgtgggggtcacca

SEQ ID NO: 1786 - DNA, 47 bp, Homo Sapiens
  allele 24: 99-6415-279 : polymorphic base C or T
gcggggacagggcaggaggcttcygagcgtgtggcccctagctaggg

SEQ ID NO: 1787 - DNA, 47 bp, Homo Sapiens
  allele 24: 99-6421-210 : polymorphic base C or T
gtgcacatactcacattttgctaygtacatattcacatgcaaagcca

SEQ ID NO: 1788 - DNA, 47 bp, Homo Sapiens
  allele 24: 99-6423-90 : polymorphic base G or C
ccatctgggggcacatgaccccgsggatagcagatggaaggcagctt

SEQ ID NO: 1789 - DNA, 47 bp, Homo Sapiens
  allele 24: 99-6426-413 : polymorphic base A or G
tgtgcatgaagtcagcaagacaarcacgtttctgccctctgggagct

SEQ ID NO: 1790 - DNA, 47 bp, Homo Sapiens
  allele 24: 99-6427-190 : polymorphic base A or G
ttttgtaaactttcttagattacrgacctctttaagaatctgataaa

SEQ ID NO: 1791 - DNA, 47 bp, Homo Sapiens
  allele 24: 99-6435-343 : polymorphic base A or G
gattttaggcttctttctttggtrgtcccttctgaaatcgactcttt

SEQ ID NO: 1792 - DNA, 47 bp, Homo Sapiens
  allele 24: 99-6437-77 : polymorphic base A or C
agtggaatagggaaaaaaggaacmaaagcacagcttaactgtaaaat

SEQ ID NO: 1793 - DNA, 47 bp, Homo Sapiens
  allele 24: 99-6440-318 : polymorphic base G or C
ctctgtgaagtgtgcttatcaatsgtgacagtgtgtttattcacaaa

SEQ ID NO: 1794 - DNA, 47 bp, Homo Sapiens
  allele 24: 99-6447-178 : polymorphic base C or T
cctgctcctgttataagaaatagyttcactgttctgttgataaagtg

SEQ ID NO: 1795 - DNA, 47 bp, Homo Sapiens
  allele 24: 99-6456-165 : polymorphic base C or T
tcagagaacgaaggagtgatgcaytgggtttggagtgaatttatgca

SEQ ID NO: 1796 - DNA, 47 bp, Homo Sapiens
  allele 24: 99-6459-201 : polymorphic base A or G
ctgggtgtgggctttcatgctgcrctttctctcacatccaaatctag

SEQ ID NO: 1797 - DNA, 47 bp, Homo Sapiens
  allele 24: 99-646-271 : polymorphic base C or T
ttgaactttttccttagatttccyggattcaaatcaactgcacctca

SEQ ID NO: 1798 - DNA, 47 bp, Homo Sapiens
  allele 24: 99-6463-348 : polymorphic base A or C
tccctgaagacctctgccagctcmtgaagtccagggaagcaccaggc

SEQ ID NO: 1799 - DNA, 47 bp, Homo Sapiens
  allele 24: 99-6468-288 : polymorphic base A or G
ccactctctttcttccctccttarttttcccctgtctagaagcattt

SEQ ID NO: 1800 - DNA, 47 bp, Homo Sapiens
  allele 24: 99-6478-358 : polymorphic base A or G
tgctcaccagctgctcataatttrgcttcccaggaagatttgcctaa

SEQ ID NO: 1801 - DNA, 47 bp, Homo Sapiens
  allele 24: 99-6480-440 : polymorphic base A or G
tacaagtcagagacacagcaggtrttaaatagtagccatgtcgaggg

SEQ ID NO: 1802 - DNA, 47 bp, Homo Sapiens
  allele 24: 99-6489-237 : polymorphic base G or T
ttgttgttttgaatgagcagactkatttctgacaaatatttaaactg

SEQ ID NO: 1803 - DNA, 47 bp, Homo Sapiens
  allele 24: 99-649-422 : polymorphic base A or T
aaaccacattagacttctgttaawctttgtcacataaacaggtcttg

SEQ ID NO: 1804 - DNA, 47 bp, Homo Sapiens
  allele 24: 99-6496-340 : polymorphic base A or G
ctcttgatatttatcttaaccagrttttacatggtatgatgtgcctg

SEQ ID NO: 1805 - DNA, 47 bp, Homo Sapiens
  allele 24: 99-6511-176 : polymorphic base C or T
acacaaaaccttcccagactaaaytcagcctatgaagatcttgcctg

SEQ ID NO: 1806 - DNA, 47 bp, Homo Sapiens
  allele 24: 99-6525-196 : polymorphic base C or T
acagcaggcttacataagatatayttacctcaatttaaatatgtaaa

SEQ ID NO: 1807 - DNA, 47 bp, Homo Sapiens
  allele 24: 99-6527-95 : polymorphic base A or C
cactttcctctcgctggtgctgtmtttggtagagccatagatagaac

SEQ ID NO: 1808 - DNA, 43 bp, Homo Sapiens
  allele 24: 99-6529-519 : polymorphic base C or T
tcagatatcaagatttattacgaygctatactaagaaagtaaa

SEQ ID NO: 1809 - DNA, 47 bp, Homo Sapiens
  allele 24: 99-6539-298 : polymorphic base A or G
aattcaatgtataccgatgttctragagagtggacattcggcagtta

SEQ ID NO: 1810 - DNA, 47 bp, Homo Sapiens
  allele 24: 99-6557-401 : polymorphic base A or G
aaaattcccatggaatctcaaggrgctttgagtagccaaagcaatct

SEQ ID NO: 1811 - DNA, 47 bp, Homo Sapiens
  allele 24: 99-658-367 : polymorphic base A or G
caagcagatttggcaataacccarttaggctgatgttaagtgaatga

SEQ ID NO: 1812 - DNA, 47 bp, Homo Sapiens
  allele 24: 99-6581-45 : polymorphic base C or T
gagaattgaacacaatactttacygttatgaacattacttaaatgcc

SEQ ID NO: 1813 - DNA, 47 bp, Homo Sapiens
  allele 24: 99-6586-359 : polymorphic base A or G
agcagagaactaggcccagcaacrtggaattgaaggcttcagatgat

SEQ ID NO: 1814 - DNA, 47 bp, Homo Sapiens
  allele 24: 99-6588-94 : polymorphic base C or T
ttaaaaatatgggtattttccccygcgagttaaataagcacaaaaca

SEQ ID NO: 1815 - DNA, 47 bp, Homo Sapiens
  allele 24: 99-6595-322 : polymorphic base G or C
aaatgaaatacgatatagtcatasgatgagttagcatgcacttattc

SEQ ID NO: 1816 - DNA, 47 bp, Homo Sapiens
  allele 24: 99-6609-103 : polymorphic base C or T
gccatcagccattgtctctttccygtctgttcttcatgccaggatgg

SEQ ID NO: 1817 - DNA, 47 bp, Homo Sapiens
  allele 24: 99-6612-185 : polymorphic base G or T
tgacctcaagagccccattgttaktgcttctcattttgacacagatg

SEQ ID NO: 1818 - DNA, 47 bp, Homo Sapiens
  allele 24: 99-6613-223 : polymorphic base G or C
ccyactgcatcagataactggtgsatcaaatggtttagatcttggga

SEQ ID NO: 1819 - DNA, 47 bp, Homo Sapiens
  allele 24: 99-6620-294 : polymorphic base A or C
ggtagagcaggcaaagctaggacmtgctgcaaagtctccagagaaga

SEQ ID NO: 1820 - DNA, 47 bp, Homo Sapiens
  allele 24: 99-6628-474 : polymorphic base A or C
attagttttaattttatttatatmcttaattctatttaccagaaatt

SEQ ID NO: 1821 - DNA, 47 bp, Homo Sapiens
  allele 24: 99-6639-290 : polymorphic base C or T
tcttgattcaccatattttctaaygcttctttgcctttatctcgtct

SEQ ID NO: 1822 - DNA, 47 bp, Homo Sapiens
  allele 24: 99-6640-342 : polymorphic base A or T
atatgaaatttcccttatattccwcctacagccatccttactccagt

SEQ ID NO: 1823 - DNA, 47 bp, Homo Sapiens
  allele 24: 99-6646-465 : polymorphic base A or G
tgaaaactactctctcatcaatcratcaaatttctattatctgaagt

SEQ ID NO: 1824 - DNA, 47 bp, Homo Sapiens
  allele 24: 99-6667-63 : polymorphic base C or T
ccagcaagaccattttaattatgyagccatgcacttgcttctgggtg

SEQ ID NO: 1825 - DNA, 47 bp, Homo Sapiens
  allele 24: 99-6672-314 : polymorphic base G or T
aagtgtggatataatacctgttckctgggcagctgtgaggatatgtg

SEQ ID NO: 1826 - DNA, 47 bp, Homo Sapiens
  allele 24: 99-6675-324 : polymorphic base A or G
atgatgaatccagtagctatttcrtcagatgtattcttactgtcatc

SEQ ID NO: 1827 - DNA, 47 bp, Homo Sapiens
  allele 24: 99-6688-363 : polymorphic base A or G
tttccttaacaaaataaaactttrtgttgaaaacaaaataaaatttt

SEQ ID NO: 1828 - DNA, 47 bp, Homo Sapiens
  allele 24: 99-669-291 : polymorphic base A or C
attatatggtgccttttcttttgmcacgtcaataaatatattgctta

SEQ ID NO: 1829 - DNA, 47 bp, Homo Sapiens
  allele 24: 99-6697-80 : polymorphic base A or T
tctttcactattttcacctgctawctgaggctcccagacctcccttg

SEQ ID NO: 1830 - DNA, 47 bp, Homo Sapiens
  allele 24: 99-670-274 : polymorphic base A or G
acattagtgattttaaaacattcratggtatcatataggcatttaag

SEQ ID NO: 1831 - DNA, 47 bp, Homo Sapiens
  allele 24: 99-6705-101 : polymorphic base C or T
gaccatgtagacagaaagcagatyagtagtagccttgggctggagtg

SEQ ID NO: 1832 - DNA, 47 bp, Homo Sapiens
  allele 24: 99-6706-308 : polymorphic base C or T
atcagtgctatttgaaaatcccaygtaggtaagaggacagggaggca

SEQ ID NO: 1833 - DNA, 47 bp, Homo Sapiens
  allele 24: 99-6715-439 : polymorphic base C or T
tcaaagggctgttaacatggagcycccagcaccccttgtgcataggg

SEQ ID NO: 1834 - DNA, 47 bp, Homo Sapiens
  allele 24: 99-6726-341 : polymorphic base A or T
gttgctttttatttctttctcttwcagtttggcaactttgtagctac

SEQ ID NO: 1835 - DNA, 47 bp, Homo Sapiens
  allele 24: 99-6730-356 : polymorphic base A or G
gcctagaccagaacttaattttcrtcactcttctttgagttcttcat

SEQ ID NO: 1836 - DNA, 47 bp, Homo Sapiens
  allele 24: 99-6753-79 : polymorphic base A or C
tgagccagatctgtctatgagtgmcaaattgctgtctcagcgctgct

SEQ ID NO: 1837 - DNA, 47 bp, Homo Sapiens
  allele 24: 99-6757-288 : polymorphic base G or T
ccatatcttctcattaacaatttktaccatcttctacttcattagag

SEQ ID NO: 1838 - DNA, 47 bp, Homo Sapiens
  allele 24: 99-676-357 : polymorphic base A or G
cagcttcttttatttgccatttcracatattcctagggtttcattta

SEQ ID NO: 1839 - DNA, 47 bp, Homo Sapiens
  allele 24: 99-6781-263 : polymorphic base G or T
aacacctgtgtgcagtagatttckctctctttggataaaggcaattc

SEQ ID NO: 1840 - DNA, 47 bp, Homo Sapiens
  allele 24: 99-6790-378 : polymorphic base C or T
tgtgtccaatcatcacccagtttycccatttattctaccgtggtgaa

SEQ ID NO: 1841 - DNA, 47 bp, Homo Sapiens
  allele 24: 99-680-228 : polymorphic base A or G
catattatttacactcaatagtcrtatgaggaatgacacacttgaat

SEQ ID NO: 1842 - DNA, 47 bp, Homo Sapiens
  allele 24: 99-6804-426 : polymorphic base A or G
tgggattaagtcaaaatgaggccrttagggtaaggccctaatccaat

SEQ ID NO: 1843 - DNA, 47 bp, Homo Sapiens
  allele 24: 99-6815-484 : polymorphic base G or C
ttgattaaattgaggcttgcaaasataatactgtttcttgtatttac

SEQ ID NO: 1844 - DNA, 47 bp, Homo Sapiens
  allele 24: 99-6820-251 : polymorphic base A or G
gatagtagcagtggtagcaggggraaaagtaaatttctcctttactc

SEQ ID NO: 1845 - DNA, 47 bp, Homo Sapiens
  allele 24: 99-6832-178 : polymorphic base C or T
gcttcttgaggctgaccaatcatygcgatgaatgacaaaatctttcc

SEQ ID NO: 1846 - DNA, 47 bp, Homo Sapiens
  allele 24: 99-6856-433 : polymorphic base A or G
atggggcctggcaaataggaggtrcctttaaaacgcttgttgagcag

SEQ ID NO: 1847 - DNA, 47 bp, Homo Sapiens
  allele 24: 99-6865-455 : polymorphic base C or T
tgagacagggatgggagtgcaaayagtttatttgggagatgatttca

SEQ ID NO: 1848 - DNA, 47 bp, Homo Sapiens
  allele 24: 99-6866-130 : polymorphic base A or G
ttcgcataaggtcataaacatggrgccctaattcaaaaggattaatg

SEQ ID NO: 1849 - DNA, 47 bp, Homo Sapiens
  allele 24: 99-6869-256 : polymorphic base A or G
acaagacatataacaggggtgtgrctcccctctttggtctctgccac

SEQ ID NO: 1850 - DNA, 47 bp, Homo Sapiens
  allele 24: 99-6876-229 : polymorphic base C or T
gtgactcagtctccagagcttaayatccccccttggcataataaatt

SEQ ID NO: 1851 - DNA, 47 bp, Homo Sapiens
  allele 24: 99-689-219 : polymorphic base C or T
ggtccaggcttttaaaatgattcyttggacagtaatgcttcagacct

SEQ ID NO: 1852 - DNA, 47 bp, Homo Sapiens
  allele 24: 99-6893-392 : polymorphic base C or T
cctttctctctcttttataaatgytaaccacaggagaatctttagta

SEQ ID NO: 1853 - DNA, 47 bp, Homo Sapiens
  allele 24: 99-6895-144 : polymorphic base A or T
aactcaggacggtagtgtctttcwgaaatcatggtgacttgctagct

SEQ ID NO: 1854 - DNA, 47 bp, Homo Sapiens
  allele 24: 99-6938-347 : polymorphic base G or T
gcccaagagttctgggctttctgkgctctgtgcccatcgggtgccca

SEQ ID NO: 1855 - DNA, 47 bp, Homo Sapiens
  allele 24: 99-694-236 : polymorphic base G or T
tctaaatttttataccagttaagktacacttttatgattcataatat

SEQ ID NO: 1856 - DNA, 47 bp, Homo Sapiens
  allele 24: 99-6940-464 : polymorphic base A or G
atagctctatagttttccataacrtgattgcattgtgactgatttaa

SEQ ID NO: 1857 - DNA, 47 bp, Homo Sapiens
  allele 24: 99-6942-313 : polymorphic base A or C
gccctgtggaggccttgggggcamcccacaggagactaaaagactag

SEQ ID NO: 1858 - DNA, 47 bp, Homo Sapiens
  allele 24: 99-6951-410 : polymorphic base G or T
catggcctttctcctcccatagtkccaatgtagtcgataactaccct

SEQ ID NO: 1859 - DNA, 47 bp, Homo Sapiens
  allele 24: 99-6956-58 : polymorphic base C or T
aaggtgaatctacagcagatcacygtcaaagaaattttaagtaaaaa

SEQ ID NO: 1860 - DNA, 47 bp, Homo Sapiens
  allele 24: 99-6957-137 : polymorphic base G or C
ctgcggctgatgggtgagctgcastgttttgtgacaactttcagtgt

SEQ ID NO: 1861 - DNA, 47 bp, Homo Sapiens
  allele 24: 99-6960-412 : polymorphic base A or T
tgcatcaataaccttatttttacwaatgaagaaactgaagttttctg

SEQ ID NO: 1862 - DNA, 47 bp, Homo Sapiens
  allele 24: 99-6962-34 : polymorphic base G or C
cattgatgttctcagtcgtgtttstctaatgagatgatgttggacat

SEQ ID NO: 1863 - DNA, 47 bp, Homo Sapiens
  allele 24: 99-6979-64 : polymorphic base C or T
ggcaggtaactcctttatggagtytgaacttgccgccaacagggaag

SEQ ID NO: 1864 - DNA, 47 bp, Homo Sapiens
  allele 24: 99-6986-157 : polymorphic base A or G
taaatgtttattgctgcattcccracacccccagtgtattactgttt

SEQ ID NO: 1865 - DNA, 47 bp, Homo Sapiens
  allele 24: 99-6988-236 : polymorphic base A or C
ttagggtacacatttcttccctgmatacccaactggcaattctattt

SEQ ID NO: 1866 - DNA, 47 bp, Homo Sapiens
  allele 24: 99-6989-397 : polymorphic base A or G
tcacattgtacatagcaagatgaraagagagggaaaggaacagcact

SEQ ID NO: 1867 - DNA, 47 bp, Homo Sapiens
  allele 24: 99-6996-217 : polymorphic base C or T
tcacagccaacttctgagatgagyattattttaatgatgaggaattg

SEQ ID NO: 1868 - DNA, 47 bp, Homo Sapiens; identical to SEQ ID NO: 920
  allele 24: 99-700-123 : polymorphic base A or G

SEQ ID NO: 1869 - DNA, 47 bp, Homo Sapiens
  allele 24: 99-7000-235 : polymorphic base G or C
gcaaccatatcacttaagtgaggsaaagtatgctgagaatgaagctt

SEQ ID NO: 1870 - DNA, 47 bp, Homo Sapiens
  allele 24: 99-7004-304 : polymorphic base A or G
atgtttggaaggtgccacagacarcgttatgtcccttccaattcaca

SEQ ID NO: 1871 - DNA, 47 bp, Homo Sapiens
  allele 24: 99-7013-250 : polymorphic base C or T
gggggtccccagatgcccccttgytcggccttcctggggtggatgga

SEQ ID NO: 1872 - DNA, 47 bp, Homo Sapiens
  allele 24: 99-7024-122 : polymorphic base G or T
tttactctatgaattttgtagatkcatgaacattcagtacatacctt

SEQ ID NO: 1873 - DNA, 47 bp, Homo Sapiens
  allele 24: 99-7025-226 : polymorphic base C or T
ctaaggtatagttcatattaaaaytccaacccttcccctcccatctt

SEQ ID NO: 1874 - DNA, 47 bp, Homo Sapiens
  allele 24: 99-7026-247 : polymorphic base C or T
gaggcaggaacttgttatctctgycatccggtcccatgttggggaac

SEQ ID NO: 1875 - DNA, 47 bp, Homo Sapiens
  allele 24: 99-7047-225 : polymorphic base C or T
atcggggagtgagatcccagattytgagctgggaacagaagtccctg

SEQ ID NO: 1876 - DNA, 47 bp, Homo Sapiens
  allele 24: 99-7056-49 : polymorphic base A or G
ttttccattggccactccatttgrcatttccactgacaatgtcttat

SEQ ID NO: 1877 - DNA, 47 bp, Homo Sapiens
  allele 24: 99-708-243 : polymorphic base C or T
atttatatatgaaaaagagagtayatgataatagttttttttcaaaa

SEQ ID NO: 1878 - DNA, 47 bp, Homo Sapiens
  allele 24: 99-7084-187 : polymorphic base C or T
ttacatcacaggctgctgtgcagygatggtatttacaagactagact

SEQ ID NO: 1879 - DNA, 47 bp, Homo Sapiens
  allele 24: 99-7090-294 : polymorphic base A or G
gacccagggctggccgtgcacacrgctgttggaggatcattgcttcc

SEQ ID NO: 1880 - DNA, 47 bp, Homo Sapiens
  allele 24: 99-7093-36 : polymorphic base A or C
cattcctaggatatggtatacttmtcatatttcaaaaatattgtttg

SEQ ID NO: 1881 - DNA, 47 bp, Homo Sapiens
  allele 24: 99-7098-382 : polymorphic base A or G
gccacaggcaccggcggggttccrcctgggacctgaggctggacttc

SEQ ID NO: 1882 - DNA, 47 bp, Homo Sapiens
  allele 24: 99-7103-155 : polymorphic base C or T
gtggaacacttgctggctagtcayttttcaaacattgttcttatcac

SEQ ID NO: 1883 - DNA, 47 bp, Homo Sapiens
  allele 24: 99-7104-187 : polymorphic base A or G
tccatttaatggatgtcacctgcrtgaaacagggccttattggccca

SEQ ID NO: 1884 - DNA, 47 bp, Homo Sapiens
  allele 24: 99-7107-143 : polymorphic base A or G
tctaataggagggaaaggaaaccracactgctgagtgcctgcccaat

SEQ ID NO: 1885 - DNA, 47 bp, Homo Sapiens
  allele 24: 99-7114-31 : polymorphic base A or G
ccagagaaatgtaagccagccagrcctcctgagacccttcctctctg

SEQ ID NO: 1886 - DNA, 47 bp, Homo Sapiens
  allele 24: 99-7119-278 : polymorphic base A or G
tggaaatacctagtgaaaggaccrtttctgcattctagggatctcca

SEQ ID NO: 1887 - DNA, 47 bp, Homo Sapiens
  allele 24: 99-7129-335 : polymorphic base A or C
tttttaagtataacacattcagamattaaacaaacataaatgtatgt

SEQ ID NO: 1888 - DNA, 47 bp, Homo Sapiens
  allele 24: 99-7131-259 : polymorphic base C or T
ggagaaagataatgaatgagaatyaaaacctaccagaagatgtgatt

SEQ ID NO: 1889 - DNA, 47 bp, Homo Sapiens
  allele 24: 99-7136-329 : polymorphic base C or T
tagaagtcattttgcttggtggtygatagggtgtagggtataaggaa

SEQ ID NO: 1890 - DNA, 47 bp, Homo Sapiens
  allele 24: 99-7137-420 : polymorphic base C or T
gttttatttcttaaaggtaataayataaagcaaatatggcacaatgt

SEQ ID NO: 1891 - DNA, 47 bp, Homo Sapiens
  allele 24: 99-7140-355 : polymorphic base A or G
aaccattttgtagattttaaagcrttagtttgcaggaactaattatg

SEQ ID NO: 1892 - DNA, 47 bp, Homo Sapiens
  allele 24: 99-7141-395 : polymorphic base A or G
ttccctctcaacctccaactcctrcaaatctcatgtccccctctgag

SEQ ID NO: 1893 - DNA, 47 bp, Homo Sapiens
  allele 24: 99-7144-261 : polymorphic base C or T
ggcctttccagatgtctcagttcygtggaaccccaccttcttttaaa

SEQ ID NO: 1894 - DNA, 47 bp, Homo Sapiens
  allele 24: 99-7148-262 : polymorphic base C or T
acacacacacacacacacacacayacgtatagttatataaagctgat

SEQ ID NO: 1895 - DNA, 47 bp, Homo Sapiens
  allele 24: 99-7167-438 : polymorphic base A or G
ttacctgctgaaatctcttatgarttctaataatttgctcattgaca

SEQ ID NO: 1896 - DNA, 47 bp, Homo Sapiens
  allele 24: 99-7172-441 : polymorphic base A or G
tatatgatcccactttcctttttraaaaatccctataacatgaatat

SEQ ID NO: 1897 - DNA, 47 bp, Homo Sapiens
  allele 24: 99-7177-81 : polymorphic base C or T
gctgaggggatcagcctactagayggaggcaggtgtttcaagatggt

SEQ ID NO: 1898 - DNA, 47 bp, Homo Sapiens
  allele 24: 99-718-261 : polymorphic base A or G
ctgcagcgggggaggcacagctgrggaggcacagctggggctgtggg

SEQ ID NO: 1899 - DNA, 47 bp, Homo Sapiens
  allele 24: 99-7183-338 : polymorphic base A or G
ttttttaaattactgttgtgtccrtactgttagcactgggagatttc

SEQ ID NO: 1900 - DNA, 47 bp, Homo Sapiens
  allele 24: 99-7193-228 : polymorphic base G or C
ataccttgactctgcttctcgcastgttgactgaggtcatacttgca

SEQ ID NO: 1901 - DNA, 47 bp, Homo Sapiens
  allele 24: 99-72-109 : polymorphic base C or T
atccaacacagaaaccgctaaaaycaggcagaagctgtctgcagaga

SEQ ID NO: 1902 - DNA, 47 bp, Homo Sapiens
  allele 24: 99-7212-346 : polymorphic base C or T
aagacaagattccttcaaggtagygctctcacgttttcattcaatga

SEQ ID NO: 1903 - DNA, 47 bp, Homo Sapiens
  allele 24: 99-7214-109 : polymorphic base C or T
cctgcctaccatggtggtctgccygagggacaagtgacctacctctg

SEQ ID NO: 1904 - DNA, 47 bp, Homo Sapiens
  allele 24: 99-7218-444 : polymorphic base C or T
ccctcctgagctccagacccacgytcctccgtgggggtgtttcataa

SEQ ID NO: 1905 - DNA, 47 bp, Homo Sapiens
  allele 24: 99-7234-101 : polymorphic base A or T
actcatgcttaggtaagccactgwcccttcggccaagtcaaaaacct

SEQ ID NO: 1906 - DNA, 47 bp, Homo Sapiens
  allele 24: 99-724-246 : polymorphic base A or G
atggttttatttattttttaaatratacataatgtttgtatatattt

SEQ ID NO: 1907 - DNA, 47 bp, Homo Sapiens
  allele 24: 99-7252-279 : polymorphic base C or T
acttgaattgaacactttgaacaygtgccattagtttcctgctaaaa

SEQ ID NO: 1908 - DNA, 47 bp, Homo Sapiens
  allele 24: 99-7274-172 : polymorphic base C or T
ctctcattctatagtgtgtgcctyggctgcttttacagggccaatct

SEQ ID NO: 1909 - DNA, 47 bp, Homo Sapiens
  allele 24: 99-7275-150 : polymorphic base C or T
atatctccttaagatttgattttyagccaggcatggtggctcacacc

SEQ ID NO: 1910 - DNA, 47 bp, Homo Sapiens
  allele 24: 99-7276-286 : polymorphic base A or G
tatttattgaatcaatgcaatttrattcaccttttttatacattaaa

SEQ ID NO: 1911 - DNA, 47 bp, Homo Sapiens
  allele 24: 99-7293-201 : polymorphic base A or G
taggtgagtgacactgcatctgcrtgtttttcttttttattggcctt

SEQ ID NO: 1912 - DNA, 47 bp, Homo Sapiens
  allele 24: 99-73-140 : polymorphic base C or T
gtagacaagattgagaacctaacytaggagtatgcacctgtaacaat

SEQ ID NO: 1913 - DNA, 47 bp, Homo Sapiens
  allele 24: 99-7311-179 : polymorphic base A or G
tgttcaaaatattttgtcatattrtaattttgtgatatagtgaatga

SEQ ID NO: 1914 - DNA, 47 bp, Homo Sapiens
  allele 24: 99-7312-177 : polymorphic base A or G
ttctgggacctcagcaggcccggraatgcagagagggcctcaaggct

SEQ ID NO: 1915 - DNA, 47 bp, Homo Sapiens
  allele 24: 99-7323-178 : polymorphic base A or C
agcttataaaatattgaaaaaaamcagtaatacttcgtgttgtctta

SEQ ID NO: 1916 - DNA, 47 bp, Homo Sapiens
  allele 24: 99-7326-94 : polymorphic base G or C
gacacagaatccagagagataggstcagtgttccaaaattcaaagtt

SEQ ID NO: 1917 - DNA, 47 bp, Homo Sapiens
  allele 24: 99-7334-350 : polymorphic base C or T
gaataaaagagataaaattaaagyaaacctgaacttcatgtatcaga

SEQ ID NO: 1918 - DNA, 47 bp, Homo Sapiens
  allele 24: 99-734-126 : polymorphic base C or T
taaaaaaaaatctgagaaaaataygcattatagaagatagggttgaa

SEQ ID NO: 1919 - DNA, 47 bp, Homo Sapiens
  allele 24: 99-7349-384 : polymorphic base G or C
ggatggtgtgctgagactggaaasccaaaatgatggtaactgagagc

SEQ ID NO: 1920 - DNA, 47 bp, Homo Sapiens
  allele 24: 99-7356-176 : polymorphic base A or G
agccatttctgttctcctctccartccaggcctcccctcctccctta

SEQ ID NO: 1921 - DNA, 47 bp, Homo Sapiens
  allele 24: 99-7363-474 : polymorphic base C or T
catgtaaatatgtcacatgaagayaggttcaatacagaatgtacgtg

SEQ ID NO: 1922 - DNA, 47 bp, Homo Sapiens
  allele 24: 99-737-372 : polymorphic base A or G
tgtcataaagatataagaagtttrtttgttctctggataaagctaat

SEQ ID NO: 1923 - DNA, 47 bp, Homo Sapiens
  allele 24: 99-7373-339 : polymorphic base A or G
ttgttaaatgtaggtagatgggtrtatagcagtttatagtatcctct

SEQ ID NO: 1924 - DNA, 47 bp, Homo Sapiens
  allele 24: 99-7374-230 : polymorphic base A or G
gtagtttcctgggtatggagtacrgtcacaagatacatgcaagaaac

SEQ ID NO: 1925 - DNA, 47 bp, Homo Sapiens
  allele 24: 99-7375-210 : polymorphic base C or T
gtaatctctagtagagttaagctytgtaaaggcctgtgaatattctg

SEQ ID NO: 1926 - DNA, 47 bp, Homo Sapiens
  allele 24: 99-7376-157 : polymorphic base A or T
catatccttttacttagaaatgcwgcagtttagatctagacaaatta

SEQ ID NO: 1927 - DNA, 47 bp, Homo Sapiens
  allele 24: 99-7380-255 : polymorphic base A or G
ctgagagctgagtcaagacctctrtggctgccacttcctccagtgtt

SEQ ID NO: 1928 - DNA, 47 bp, Homo Sapiens
  allele 24: 99-7387-414 : polymorphic base C or T
attagcttcagaagaaaaatgggyactagaggggcacatgactgtgg

SEQ ID NO: 1929 - DNA, 47 bp, Homo Sapiens
  allele 24: 99-7391-356 : polymorphic base C or T
tcatggaaagcacaatcccagagygacagagagaaattcttactaac

SEQ ID NO: 1930 - DNA, 47 bp, Homo Sapiens
  allele 24: 99-7396-228 : polymorphic base A or T
gggttatcagcagtgtgataattwaaaaaaaactaatcacaatatta

SEQ ID NO: 1931 - DNA, 47 bp, Homo Sapiens; identical to SEQ ID NO: 1034
  allele 24: 99-7402-110 : polymorphic base C or T

SEQ ID NO: 1932 - DNA, 47 bp, Homo Sapiens
  allele 24: 99-7405-92 : polymorphic base C or T
cagggggctcgctgacctactttyttctttcatttgctgccctacag

SEQ ID NO: 1933 - DNA, 47 bp, Homo Sapiens
  allele 24: 99-7406-380 : polymorphic base A or G
tcaatttggtattccttcaggtgrgtgagtgctggaggcttctattc

SEQ ID NO: 1934 - DNA, 47 bp, Homo Sapiens
  allele 24: 99-7417-440 : polymorphic base C or T
aatgttaaaaactaaccaaatatygtggggataattttgtgccagtt

SEQ ID NO: 1935 - DNA, 47 bp, Homo Sapiens
  allele 24: 99-7429-204 : polymorphic base G or T
gtagagggctgccctgggtggagktggcgggtaattcccagcacttc

SEQ ID NO: 1936 - DNA, 47 bp, Homo Sapiens
  allele 24: 99-7447-281 : polymorphic base G or C
ctacatcttccttcatgtaatgtstgttctatccttgccataatttt

SEQ ID NO: 1937 - DNA, 47 bp, Homo Sapiens
  allele 24: 99-7453-405 : polymorphic base C or T
tctctattaacatgttgacagtgygcccgggaacgttggctctagga

SEQ ID NO: 1938 - DNA, 47 bp, Homo Sapiens
  allele 24: 99-7454-35 : polymorphic base G or C
gagagggttcctgctcctacgggsactgcggagstcccgtttgtacc

SEQ ID NO: 1939 - DNA, 47 bp, Homo Sapiens
  allele 24: 99-747-252 : polymorphic base A or G
tctggccaaatcgtggaaaacagraaggattttaacaaacggaaatg

SEQ ID NO: 1940 - DNA, 47 bp, Homo Sapiens
  allele 24: 99-7475-179 : polymorphic base G or T
tgcttcatgtactgagtaattccktattgtcttctggcattgtggtc

SEQ ID NO: 1941 - DNA, 47 bp, Homo Sapiens
  allele 24: 99-7480-66 : polymorphic base A or G
ctttctgcaccaccttctgaattrtttggtttccagggagacatcga

SEQ ID NO: 1942 - DNA, 47 bp, Homo Sapiens
  allele 24: 99-7492-275 : polymorphic base C or T
agtttcccagccttattttatcaycaaactctttttccagagaatct

SEQ ID NO: 1943 - DNA, 47 bp, Homo Sapiens
  allele 24: 99-7493-249 : polymorphic base G or C
atcacttggagatgtgaccattasatagaaaagttttcgtaactgat

SEQ ID NO: 1944 - DNA, 47 bp, Homo Sapiens
  allele 24: 99-7502-382 : polymorphic base A or T
gttgaatatattattcataaaaawtccttctgaggataaattctaac

SEQ ID NO: 1945 - DNA, 47 bp, Homo Sapiens
  allele 24: 99-7504-342 : polymorphic base A or C
gcagagatgaaggcagggagatgmtgttttatagcaactttaattag

SEQ ID NO: 1946 - DNA, 47 bp, Homo Sapiens
  allele 24: 99-7520-222 : polymorphic base A or G
atagattatagagtgacagtagargaagtcagctctctgattgctgt

SEQ ID NO: 1947 - DNA, 47 bp, Homo Sapiens
  allele 24: 99-7524-130 : polymorphic base A or G
cattttacttccaaatccatcatragttttacaacttaataaacact

SEQ ID NO: 1948 - DNA, 44 bp, Homo Sapiens
  allele 24: 99-7543-467 : polymorphic base A or G
aatagcagttgattactgaggacrtaccttccctccagtttcaa

SEQ ID NO: 1949 - DNA, 47 bp, Homo Sapiens
  allele 24: 99-755-83 : polymorphic base A or T
agaacatgtgcaagagtcctgaawtgaaagaatactgggccccattc

SEQ ID NO: 1950 - DNA, 47 bp, Homo Sapiens
  allele 24: 99-7598-388 : polymorphic base A or G
ttttttacagacaccaggcactcraacaatcttttattaattgaatg

SEQ ID NO: 1951 - DNA, 47 bp, Homo Sapiens
  allele 24: 99-760-261 : polymorphic base C or T
tctgtttggtaaagataacttgcycaaggtcattaagtctatgctac

SEQ ID NO: 1952 - DNA, 47 bp, Homo Sapiens
  allele 24: 99-7604-309 : polymorphic base A or G
atggagtaaacctggacacagacrgccgggcatgggtcaccatccgg

SEQ ID NO: 1953 - DNA, 47 bp, Homo Sapiens
  allele 24: 99-7605-62 : polymorphic base G or C
agaacctgattctcagctgccagscagattgaacccaccccttcccc

SEQ ID NO: 1954 - DNA, 47 bp, Homo Sapiens
  allele 24: 99-7608-388 : polymorphic base C or T
acatatatcatctcaagaactttyaaaaaggaaaacttcctggttcc

SEQ ID NO: 1955 - DNA, 47 bp, Homo Sapiens
  allele 24: 99-7610-444 : polymorphic base C or T
gtctcccacttgaagaatatggcyggctttcagaattaggagagagt

SEQ ID NO: 1956 - DNA, 47 bp, Homo Sapiens
  allele 24: 99-7611-156 : polymorphic base A or G
cagacaaggcccctttatttcctragccacctctcacacctggacac

SEQ ID NO: 1957 - DNA, 47 bp, Homo Sapiens
  allele 24: 99-7614-28 : polymorphic base A or T
ccctgttttttttccaacagagcwagagttgtaatgcacatgaaaat

SEQ ID NO: 1958 - DNA, 47 bp, Homo Sapiens
  allele 24: 99-763-240 : polymorphic base A or G
tgtttactgatatttatatacttrtatatgttcatttacatgtatat

SEQ ID NO: 1959 - DNA, 47 bp, Homo Sapiens
  allele 24: 99-7642-191 : polymorphic base A or G
agtgcagcaagacaggaaggaggrgaatgaatcacttcacttgggac

SEQ ID NO: 1960 - DNA, 47 bp, Homo Sapiens
  allele 24: 99-7643-350 : polymorphic base C or T
ataagatccttagaatgaaggaaygcacaaactgcaaaaaattactc

SEQ ID NO: 1961 - DNA, 47 bp, Homo Sapiens
  allele 24: 99-7650-187 : polymorphic base G or C
aaagagagatcaggcaggacaaasagcaggtggacaccggagaagtg

SEQ ID NO: 1962 - DNA, 47 bp, Homo Sapiens
  allele 24: 99-7671-33 : polymorphic base G or C
gttacctttgccgaaaagggcgastgcgcaagtccattttctcggag

SEQ ID NO: 1963 - DNA, 47 bp, Homo Sapiens
  allele 24: 99-7677-107 : polymorphic base C or T
gaaaaatctatggatcaggcagayaggccaggaggcagtggaggttc

SEQ ID NO: 1964 - DNA, 47 bp, Homo Sapiens
  allele 24: 99-7688-325 : polymorphic base C or T
atgaagcatacagttgagacataytgagtatatattgtcttaggggt

SEQ ID NO: 1965 - DNA, 47 bp, Homo Sapiens
  allele 24: 99-7692-340 : polymorphic base A or G
ttcatatttaatagggattatatraagatataagtttatcaagatta

SEQ ID NO: 1966 - DNA, 47 bp, Homo Sapiens
  allele 24: 99-77-318 : polymorphic base A or C
tgagaaatccattaaattttgaamactcatatatcttttatctttgg

SEQ ID NO: 1967 - DNA, 47 bp, Homo Sapiens
  allele 24: 99-7706-303 : polymorphic base A or G
tgatgactcccctgcctgagcttrgagctttgattccccaacgtgtg

SEQ ID NO: 1968 - DNA, 47 bp, Homo Sapiens
  allele 24: 99-771-391 : polymorphic base A or G
taataatcaagtttgatcatgccrtcaaggctacatataatttttca

SEQ ID NO: 1969 - DNA, 47 bp, Homo Sapiens
  allele 24: 99-7710-318 : polymorphic base C or T
gtgtatcctcaaactagtctccgyggatatatctgtagagattcaca

SEQ ID NO: 1970 - DNA, 47 bp, Homo Sapiens
  allele 24: 99-7712-176 : polymorphic base C or T
aggaaacatactcccagactaagyccaagatgcaaagtttggttcag

SEQ ID NO: 1971 - DNA, 47 bp, Homo Sapiens
  allele 24: 99-7721-379 : polymorphic base A or C
gtgctttaaaacagtgcaacagamacaaaaaacaggacagcggtttt

SEQ ID NO: 1972 - DNA, 47 bp, Homo Sapiens
  allele 24: 99-7727-65 : polymorphic base C or T
ctcgtaattttcatggagccaaaytcagtgtggcttcctaaatgtgg

SEQ ID NO: 1973 - DNA, 47 bp, Homo Sapiens
  allele 24: 99-7728-334 : polymorphic base A or G
atatgtagttctgagtaactcacrggttaaagaagacatcaaaaggg

SEQ ID NO: 1974 - DNA, 47 bp, Homo Sapiens
  allele 24: 99-7732-122 : polymorphic base C or T
agtatctctctcttaaggccctaycgcctctcacctcttctaaacat

SEQ ID NO: 1975 - DNA, 47 bp, Homo Sapiens
  allele 24: 99-7737-264 : polymorphic base A or G
agagtatatgtagctatattccartgtagaaaggtaaatatttctca

SEQ ID NO: 1976 - DNA, 47 bp, Homo Sapiens
  allele 24: 99-7744-255 : polymorphic base G or C
caccagcagcctccaaaagagagstattgaaagaggttatatctact

SEQ ID NO: 1977 - DNA, 47 bp, Homo Sapiens
  allele 24: 99-7745-305 : polymorphic base G or C
caatcagttcctacttcagtgatsaagagggaggtcttacttgaacc

SEQ ID NO: 1978 - DNA, 47 bp, Homo Sapiens
  allele 24: 99-7749-123 : polymorphic base C or T
ccttttggagaagaatttaggaayctgcatgtttagtaagcacccaa

SEQ ID NO: 1979 - DNA, 45 bp, Homo Sapiens
  allele 24: 99-7751-450 : polymorphic base A or G
caaagatgcccatctacaaaattrtgcagacaatttcagatccta

SEQ ID NO: 1980 - DNA, 47 bp, Homo Sapiens
  allele 24: 99-7753-199 : polymorphic base G or C
ccagttgaatgctttcaggggcasagtcagcatgccaatagatttcc

SEQ ID NO: 1981 - DNA, 47 bp, Homo Sapiens
  allele 24: 99-7754-119 : polymorphic base G or T
aatgaagaaagacaaaacatgtgkagataaggtagaatattgctgga

SEQ ID NO: 1982 - DNA, 47 bp, Homo Sapiens
  allele 24: 99-7759-63 : polymorphic base G or T
accacagtccttactttaaatggktgatcatcctggtcactctcccc

SEQ ID NO: 1983 - DNA, 47 bp, Homo Sapiens
  allele 24: 99-7762-227 : polymorphic base A or G
cattcctcttagaagaaagaccarttcccttcttagggcccacctag

SEQ ID NO: 1984 - DNA, 47 bp, Homo Sapiens
  allele 24: 99-7764-161 : polymorphic base A or G
tctttttcctctcctggtaccttrgtttaaaaatttcatttgcagag

SEQ ID NO: 1985 - DNA, 47 bp, Homo Sapiens
  allele 24: 99-7775-313 : polymorphic base C or T
ctgtaatgaagtgattttaaattyttattttagaaatagttaactag

SEQ ID NO: 1986 - DNA, 47 bp, Homo Sapiens
  allele 24: 99-7784-31 : polymorphic base C or T
tctggctgcaactgaggcaatctytcctgttagtatcaattatctcg

SEQ ID NO: 1987 - DNA, 47 bp, Homo Sapiens
  allele 24: 99-7789-404 : polymorphic base G or T
gataaaaccaaggagaggtaggcktggggtgcacattgcaatagatt

SEQ ID NO: 1988 - DNA, 47 bp, Homo Sapiens
  allele 24: 99-7792-173 : polymorphic base C or T
tggaggaatgagatgaccaggcaygtcacggaggcagtgcagggtca

SEQ ID NO: 1989 - DNA, 47 bp, Homo Sapiens
  allele 24: 99-7796-130 : polymorphic base G or C
cctgggcctgaaaaccatgggctstttcacaaactatgctctgctca

SEQ ID NO: 1990 - DNA, 47 bp, Homo Sapiens
  allele 24: 99-7803-253 : polymorphic base A or G
gggtttggagcctacatgtacctragtgtcccttgtactgtggtatc

SEQ ID NO: 1991 - DNA, 47 bp, Homo Sapiens
  allele 24: 99-781-64 : polymorphic base A or G
tagatatcaggatgtcttccataratgtaagaaggtaatactgttac

SEQ ID NO: 1992 - DNA, 47 bp, Homo Sapiens
  allele 24: 99-7840-281 : polymorphic base A or C
tgccaacttgaatacattagaagmaagaataacagagtcagcactat

SEQ ID NO: 1993 - DNA, 47 bp, Homo Sapiens
  allele 24: 99-785-360 : polymorphic base A or G
tggagtaatatgtgtttggaggcrctgaaaaaacattgtgctgatca

SEQ ID NO: 1994 - DNA, 47 bp, Homo Sapiens
  allele 24: 99-7868-204 : polymorphic base A or G
aaaagttttatctcagcctaattracattcagagatcagatggaaaa

SEQ ID NO: 1995 - DNA, 47 bp, Homo Sapiens
  allele 24: 99-7869-135 : polymorphic base G or C
atttactactactgagagaacatsatattattccccaaaagctaata

SEQ ID NO: 1996 - DNA, 47 bp, Homo Sapiens
  allele 24: 99-7870-316 : polymorphic base A or C
aaagcactagggttgatatggtcmgtaataaagcatactacatactg

SEQ ID NO: 1997 - DNA, 47 bp, Homo Sapiens
  allele 24: 99-7877-363 : polymorphic base A or G
gtcaaccctaacaaggtttacatratgcacacctgtttcacaagact

SEQ ID NO: 1998 - DNA, 47 bp, Homo Sapiens
  allele 24: 99-7882-43 : polymorphic base A or G
gcactggctggctatgcctccacrttttgcctgcctttggctcctcc

SEQ ID NO: 1999 - DNA, 47 bp, Homo Sapiens
  allele 24: 99-7883-411 : polymorphic base G or C
tgtttttagactcttccctccacstcactccgcctttgcttcccaac

SEQ ID NO: 2000 - DNA, 47 bp, Homo Sapiens
  allele 24: 99-7884-151 : polymorphic base G or T
ggagagaggcagatgaagattgtkgagaccttcaggatcagtgttgg

SEQ ID NO: 2001 - DNA, 47 bp, Homo Sapiens
  allele 24: 99-7893-226 : polymorphic base A or G
agaccactgcatgtgttttcatgratttcaggcagattacaagaatg

SEQ ID NO: 2002 - DNA, 47 bp, Homo Sapiens
  allele 24: 99-7898-43 : polymorphic base A or T
ttgatcattcagtacatctaggawgaagatcatgaggttggtaaaca

SEQ ID NO: 2003 - DNA, 47 bp, Homo Sapiens
  allele 24: 99-7900-452 : polymorphic base A or G
cccaccccctcactccagactgarattagctaggaatttttatgcta

SEQ ID NO: 2004 - DNA, 47 bp, Homo Sapiens
  allele 24: 99-791-236 : polymorphic base C or T
tggaaggtcattatttagcttacyacatctgactattaaatatcact

SEQ ID NO: 2005 - DNA, 47 bp, Homo Sapiens
  allele 24: 99-7917-429 : polymorphic base A or C
tggacatatattccttgtgtatamttcaggcgttactattctagcga

SEQ ID NO: 2006 - DNA, 47 bp, Homo Sapiens
  allele 24: 99-794-393 : polymorphic base G or C
atcctctgaatttattttggaatsttaacctatttagaacaactttt

SEQ ID NO: 2007 - DNA, 47 bp, Homo Sapiens
  allele 24: 99-7949-301 : polymorphic base A or G
gcatcacaaatgcctcattatccrctccacagaagcacagcatgctg

SEQ ID NO: 2008 - DNA, 47 bp, Homo Sapiens
  allele 24: 99-795-211 : polymorphic base C or T
aaggaaacactttagacttttgaygaaaatttaggaaagatttattt

SEQ ID NO: 2009 - DNA, 47 bp, Homo Sapiens
  allele 24: 99-7967-152 : polymorphic base C or T
acaaggcaaaggtatcctgagggycaggggtaaagcccttacaggtg

SEQ ID NO: 2010 - DNA, 47 bp, Homo Sapiens
  allele 24: 99-797-238 : polymorphic base C or T
gtgatttgttcctgtcaaatatgygggatttttagacaaacacacaa

SEQ ID NO: 2011 - DNA, 47 bp, Homo Sapiens
  allele 24: 99-7985-178 : polymorphic base G or C
tctggttcaacacatcagtccggsgttgggcttcatttttgctcaaa

SEQ ID NO: 2012 - DNA, 47 bp, Homo Sapiens
  allele 24: 99-7988-389 : polymorphic base C or T
agccgcaaaggagttccacaaaayatgagacaagggaaaggtcagat

SEQ ID NO: 2013 - DNA, 47 bp, Homo Sapiens
  allele 24: 99-8002-49 : polymorphic base A or G
cattggaaagcagcagatgccacrcagagcaaatgaaaaacagaacg

SEQ ID NO: 2014 - DNA, 47 bp, Homo Sapiens
  allele 24: 99-8010-124 : polymorphic base C or T
tagcacaagattccatcacgttaytcagaatggtgcgcaatttaaac

SEQ ID NO: 2015 - DNA, 47 bp, Homo Sapiens
  allele 24: 99-8012-420 : polymorphic base A or G
cggagggaggatctagagcccgtraatctcagcagccactgctcggc

SEQ ID NO: 2016 - DNA, 47 bp, Homo Sapiens
  allele 24: 99-8013-122 : polymorphic base A or G
tcagaaggaaggggaggtagggarctccccaaggtcttgcaacacag

SEQ ID NO: 2017 - DNA, 47 bp, Homo Sapiens
  allele 24: 99-8016-267 : polymorphic base A or G
ttttgccttctgtttagtcaaggraagttttctgattggagaagaat

SEQ ID NO: 2018 - DNA, 47 bp, Homo Sapiens
  allele 24: 99-8025-306 : polymorphic base A or C
gattctctgatcttctattatatmattctccacgttttaccgagcag

SEQ ID NO: 2019 - DNA, 47 bp, Homo Sapiens
  allele 24: 99-8027-265 : polymorphic base C or T
gttcctatacccatgcactgtgaygacctaagattctggaagatttc

SEQ ID NO: 2020 - DNA, 47 bp, Homo Sapiens
  allele 24: 99-8028-87 : polymorphic base A or T
aaatctgttaataatctagaatgwttgataaagtttacatggtattt

SEQ ID NO: 2021 - DNA, 47 bp, Homo Sapiens
  allele 24: 99-8030-411 : polymorphic base G or C
gctctcagttaccatcattttggstttccagtctcagcacaccatcc

SEQ ID NO: 2022 - DNA, 47 bp, Homo Sapiens
  allele 24: 99-8046-263 : polymorphic base A or G
agattgggctctagtccaaaatgrctgtgaaatgggaggagtttttc

SEQ ID NO: 2023 - DNA, 47 bp, Homo Sapiens
  allele 24: 99-8051-125 : polymorphic base A or G
ggatgagagacacactcttcaacrtggcataagatttccatgcttgg

SEQ ID NO: 2024 - DNA, 47 bp, Homo Sapiens
  allele 24: 99-806-152 : polymorphic base C or T
ttggaaacacccaggtaccatccytgagccttctctccttggctctg

SEQ ID NO: 2025 - DNA, 47 bp, Homo Sapiens
  allele 24: 99-8063-174 : polymorphic base C or T
ttcttatgagtggcacagagtaayaggatatgatagggcggtatact

SEQ ID NO: 2026 - DNA, 47 bp, Homo Sapiens
  allele 24: 99-8067-79 : polymorphic base A or G
ttattctagtgcacatatatttgrtttttcaaaagctaaatatgcca

SEQ ID NO: 2027 - DNA, 47 bp, Homo Sapiens
  allele 24: 99-8068-258 : polymorphic base C or T
ctaaggagaggccacacatgtgaytacagttagtctgcaaactgaga

SEQ ID NO: 2028 - DNA, 47 bp, Homo Sapiens
  allele 24: 99-8081-340 : polymorphic base C or T
ccttgacttgagtactggaggcaygtcaggagcaggttataagaatg

SEQ ID NO: 2029 - DNA, 47 bp, Homo Sapiens
  allele 24: 99-8088-247 : polymorphic base A or C
gacatcctaggtaagtcaaattcmttcaacacaaattaattgagcac

SEQ ID NO: 2030 - DNA, 47 bp, Homo Sapiens
  allele 24: 99-8089-246 : polymorphic base A or G
ttgatctagtctctaagccctggrcaacccatccagtactccatctg

SEQ ID NO: 2031 - DNA, 47 bp, Homo Sapiens
  allele 24: 99-8095-164 : polymorphic base G or T
aaagttcctccacagaaatgacakttatgttgaatcaattaatactc

SEQ ID NO: 2032 - DNA, 47 bp, Homo Sapiens
  allele 24: 99-81-227 : polymorphic base C or T
tttcatacagattttaccactcayagcatcaggtatgcaaaaaacag

SEQ ID NO: 2033 - DNA, 47 bp, Homo Sapiens
  allele 24: 99-810-117 : polymorphic base A or G
tgttaggaacctcggtgatagccrgagctctgagaaacccctaggca

SEQ ID NO: 2034 - DNA, 47 bp, Homo Sapiens
  allele 24: 99-8102-124 : polymorphic base C or T
aaattcttttttatacctcaacayttaaatgataaaatgaggtatga

SEQ ID NO: 2035 - DNA, 47 bp, Homo Sapiens
  allele 24: 99-8120-354 : polymorphic base A or G
ggaatggggtgaggggaggagcarggataaggattccttctttccca

SEQ ID NO: 2036 - DNA, 47 bp, Homo Sapiens
  allele 24: 99-8128-302 : polymorphic base C or T
ataagaaatttcttgggctccctyttcattcctcttgatggaatcct

SEQ ID NO: 2037 - DNA, 47 bp, Homo Sapiens
  allele 24: 99-8141-65 : polymorphic base A or C
ccctgctctagaacatcgacatamttttacaaaatggagataatacc

SEQ ID NO: 2038 - DNA, 47 bp, Homo Sapiens; identical to SEQ ID NO: 1924
  allele 24: 99-8161-230 : polymorphic base A or G

SEQ ID NO: 2039 - DNA, 47 bp, Homo Sapiens; identical to SEQ ID NO: 1925
  allele 24: 99-8162-210 : polymorphic base C or T

SEQ ID NO: 2040 - DNA, 47 bp, Homo Sapiens
  allele 24: 99-8164-397 : polymorphic base A or G
tccaataatctcattgaaaatctragaagcgagctgaaagcgccctc

SEQ ID NO: 2041 - DNA, 47 bp, Homo Sapiens
  allele 24: 99-8170-163 : polymorphic base C or T
gctggagtagtttgctgactactygtgcaaattagtaatactcgata

SEQ ID NO: 2042 - DNA, 47 bp, Homo Sapiens
  allele 24: 99-8173-352 : polymorphic base C or T
acgaataccttctgttatgaaaaycatgtgaaaatctgaaaatcttg

SEQ ID NO: 2043 - DNA, 47 bp, Homo Sapiens; identical to SEQ ID NO: 1930
  allele 24: 99-8181-228 : polymorphic base A or T

SEQ ID NO: 2044 - DNA, 47 bp, Homo Sapiens
  allele 24: 99-8186-76 : polymorphic base G or T
gaggaaaaataatatttcctggtkaatatatttgctattggcttttg

SEQ ID NO: 2045 - DNA, 47 bp, Homo Sapiens
  allele 24: 99-8188-369 : polymorphic base G or T
ataaacacacaggacccaatagtkaataactcacaattgctaaacag

SEQ ID NO: 2046 - DNA, 47 bp, Homo Sapiens
  allele 24: 99-8192-168 : polymorphic base C or T
agctgaagcctctccttgggaccygtgttaaaaaaagaaaatggcaa

SEQ ID NO: 2047 - DNA, 47 bp, Homo Sapiens
  allele 24: 99-8219-373 : polymorphic base A or G
ctttattttgtttcagatcttagrgaaaaagtgttctatttttcatc

SEQ ID NO: 2048 - DNA, 47 bp, Homo Sapiens
  allele 24: 99-8245-192 : polymorphic base G or C
ctctccctcccagtggtggacttsagacgaggaagaaaaactgcctc

SEQ ID NO: 2049 - DNA, 47 bp, Homo Sapiens
  allele 24: 99-8255-365 : polymorphic base A or G
catcacagatgcttatcatcatcraatttaacatgccactctaatta

SEQ ID NO: 2050 - DNA, 47 bp, Homo Sapiens
  allele 24: 99-8256-148 : polymorphic base A or G
tcaataactattagctattatagrcccatagtccattacctataatg

SEQ ID NO: 2051 - DNA, 47 bp, Homo Sapiens
  allele 24: 99-8266-393 : polymorphic base A or G
gtaataaacagtattcttagaaaragtgctaatttgtgtgtgagaaa

SEQ ID NO: 2052 - DNA, 47 bp, Homo Sapiens
  allele 24: 99-827-359 : polymorphic base C or T
tttttaaatttttcttacttctcyatatatgctggtacattcattat

SEQ ID NO: 2053 - DNA, 47 bp, Homo Sapiens
  allele 24: 99-8272-122 : polymorphic base G or C
ccaaggggtcaggtgggggtaggsttggaagaaaagaggcaattgca

SEQ ID NO: 2054 - DNA, 47 bp, Homo Sapiens
  allele 24: 99-8276-65 : polymorphic base A or C
acccaaacattattactccgctcmttgcaaaaactccagacctctac

SEQ ID NO: 2055 - DNA, 47 bp, Homo Sapiens
  allele 24: 99-8278-412 : polymorphic base A or G
aaaatctggcaaagtcattgtgcrtatatcatatgattatctgatct

SEQ ID NO: 2056 - DNA, 47 bp, Homo Sapiens
  allele 24: 99-8279-252 : polymorphic base A or T
ggagcccaacttgcagcttgcttwcaggagtctggaggagcatgtca

SEQ ID NO: 2057 - DNA, 47 bp, Homo Sapiens
  allele 24: 99-828-259 : polymorphic base C or T
caccactctttaattgatactaaytttagttgcttctaatttgaggc

SEQ ID NO: 2058 - DNA, 47 bp, Homo Sapiens
  allele 24: 99-8287-122 : polymorphic base A or C
ggggtattggctatgcaacctctmtcctaaaagaagttatattggct

SEQ ID NO: 2059 - DNA, 47 bp, Homo Sapiens
  allele 24: 99-8289-179 : polymorphic base G or C
tttgctttggaagaatggcaatgsaattcagccatgtttttttctaa

SEQ ID NO: 2060 - DNA, 47 bp, Homo Sapiens
  allele 24: 99-8290-174 : polymorphic base A or G
gaagtgagagctgccaagggagcrtccgtctgtcctctctccaactc

SEQ ID NO: 2061 - DNA, 47 bp, Homo Sapiens
  allele 24: 99-8292-240 : polymorphic base A or G
ggctggcttcaggtcagccagctrtaggtcctgcttcttgtggagcc

SEQ ID NO: 2062 - DNA, 47 bp, Homo Sapiens
  allele 24: 99-8294-408 : polymorphic base A or G
tgaagagcaattttccctctatcrtctcaactctgtattctatgaaa

SEQ ID NO: 2063 - DNA, 47 bp, Homo Sapiens
  allele 24: 99-8308-237 : polymorphic base A or C
cctggggccatgcagtgccctgamaaccttctcttacttgctgtcgc

SEQ ID NO: 2064 - DNA, 47 bp, Homo Sapiens
  allele 24: 99-8313-107 : polymorphic base A or G
ctgcctggaggggccacgtggtgraaggggaataagacagcagaaag

SEQ ID NO: 2065 - DNA, 47 bp, Homo Sapiens
  allele 24: 99-8318-50 : polymorphic base A or G
cttaactttggtcaactatccatrttgttgtctagtattcttatcac

SEQ ID NO: 2066 - DNA, 47 bp, Homo Sapiens
  allele 24: 99-8328-298 : polymorphic base C or T
tcttacatgaactaatccatctayttttgaatcttcaaaatgatccc

SEQ ID NO: 2067 - DNA, 47 bp, Homo Sapiens
  allele 24: 99-8338-212 : polymorphic base G or C
aggacatcactggctatgaatttsgggtatgtgggtaccaggatggg

SEQ ID NO: 2068 - DNA, 47 bp, Homo Sapiens
  allele 24: 99-8340-364 : polymorphic base C or T
catttctggtacagattttcctgyaggaacaatttaaagaaagtgca

SEQ ID NO: 2069 - DNA, 47 bp, Homo Sapiens
  allele 24: 99-8341-99 : polymorphic base A or G
catcgtattgagctttcattttaraagaattcattctctttatgact

SEQ ID NO: 2070 - DNA, 47 bp, Homo Sapiens
  allele 24: 99-8342-33 : polymorphic base A or C
agagttttcctggacaggtaaatmttgctcaataaatgtaggtaaaa

SEQ ID NO: 2071 - DNA, 47 bp, Homo Sapiens
  allele 24: 99-8353-291 : polymorphic base A or C
gttccgcacatcatttccagttamcttccactgactggaacttagtc

SEQ ID NO: 2072 - DNA, 47 bp, Homo Sapiens
  allele 24: 99-8360-401 : polymorphic base C or T
gatcccctaagaccacagatgccytctagctggactggccggccaaa

SEQ ID NO: 2073 - DNA, 47 bp, Homo Sapiens
  allele 24: 99-8361-103 : polymorphic base C or T
aagggactcatgggcaggaggtayggcgcagggctgttgagcaatta

SEQ ID NO: 2074 - DNA, 47 bp, Homo Sapiens
  allele 24: 99-8367-239 : polymorphic base C or T
cctttgcattcaagtgtttctgcytctctctacaagcttgtctctag

SEQ ID NO: 2075 - DNA, 47 bp, Homo Sapiens
  allele 24: 99-8369-276 : polymorphic base G or T
atctgttggactgggttggggtckttataagatttggtgtattttcc

SEQ ID NO: 2076 - DNA, 47 bp, Homo Sapiens
  allele 24: 99-8377-429 : polymorphic base C or T
tccctccctcttggggttgtctgyaggtgggatgtggtgtctagggc

SEQ ID NO: 2077 - DNA, 47 bp, Homo Sapiens
  allele 24: 99-8378-69 : polymorphic base A or G
tcttgctcattcttgtgaaatctrtggggagatgcatactaagtgga

SEQ ID NO: 2078 - DNA, 47 bp, Homo Sapiens
  allele 24: 99-8379-337 : polymorphic base C or T
tcacttcacaacatattgagaacyttctttcattccattatatagtc

SEQ ID NO: 2079 - DNA, 47 bp, Homo Sapiens
  allele 24: 99-8381-114 : polymorphic base C or T
aatttaaaggtggtgagggtggcyacagtgagttgagatgaaactgg

SEQ ID NO: 2080 - DNA, 47 bp, Homo Sapiens
  allele 24: 99-8383-158 : polymorphic base G or T
tgcttaaacttaatgggatttttktgaaggaatcttctaaaaagtaa

SEQ ID NO: 2081 - DNA, 47 bp, Homo Sapiens
  allele 24: 99-8385-244 : polymorphic base A or G
ttacagatgaaggaaactccagaragggacgtgacttgccccaggtc

SEQ ID NO: 2082 - DNA, 47 bp, Homo Sapiens
  allele 24: 99-840-68 : polymorphic base A or C
atacccatagcatatctcttgaamataggagcaggaaaaaaataact

SEQ ID NO: 2083 - DNA, 47 bp, Homo Sapiens
  allele 24: 99-8402-113 : polymorphic base G or C
acttaaaacaatatgtgactgttscattcaaatttctcagagtttta

SEQ ID NO: 2084 - DNA, 47 bp, Homo Sapiens
  allele 24: 99-8414-183 : polymorphic base A or T
tatacttgagacaaattcatatawatttacctgaaggattaaaggat

SEQ ID NO: 2085 - DNA, 47 bp, Homo Sapiens
  allele 24: 99-8441-298 : polymorphic base A or C
ctcatctggtttggggtgaaggcmcatcccggttcttcatatgcgca

SEQ ID NO: 2086 - DNA, 47 bp, Homo Sapiens
  allele 24: 99-8442-95 : polymorphic base C or T
gcactcaccccagcccctgcaccygcttacctgcgtgctccccttcc

SEQ ID NO: 2087 - DNA, 47 bp, Homo Sapiens
  allele 24: 99-8453-358 : polymorphic base A or G
actcagctccaaccaactgttgcrgtaggagaatgcccactgatttt

SEQ ID NO: 2088 - DNA, 47 bp, Homo Sapiens
  allele 24: 99-8454-152 : polymorphic base C or T
ctgctgtctgatgacaggtaagcytcattatgaagtagttactacac

SEQ ID NO: 2089 - DNA, 47 bp, Homo Sapiens
  allele 24: 99-8456-266 : polymorphic base A or C
catcagagcttgaatagtgatgamtttaaaagccagaatgatttgag

SEQ ID NO: 2090 - DNA, 47 bp, Homo Sapiens
  allele 24: 99-8457-239 : polymorphic base C or T
ctaggtgggccctaagaagggaaytggtctttcttctaagaggaatg

SEQ ID NO: 2091 - DNA, 47 bp, Homo Sapiens
  allele 24: 99-8470-275 : polymorphic base A or G
aaagcattttggaagtaaattaartattaaaattcatgcccagattt

SEQ ID NO: 2092 - DNA, 47 bp, Homo Sapiens
  allele 24: 99-8472-152 : polymorphic base G or C
ataatatttatcaaagcatagctstggttttctccagtggtgggact

SEQ ID NO: 2093 - DNA, 47 bp, Homo Sapiens
  allele 24: 99-8476-216 : polymorphic base A or G
gtcacctcacccaggaagggcaargagctagggaccaccctcctcca

SEQ ID NO: 2094 - DNA, 47 bp, Homo Sapiens
  allele 24: 99-8478-385 : polymorphic base G or T
aatggaaacctagaaatgacaaakaattcaaaagtatgaatgtcaag

SEQ ID NO: 2095 - DNA, 47 bp, Homo Sapiens
  allele 24: 99-8487-245 : polymorphic base C or T
tgactttttattcttttttccctygagggtgtgactgtggtgtatgt

SEQ ID NO: 2096 - DNA, 47 bp, Homo Sapiens
  allele 24: 99-8491-339 : polymorphic base A or G
aaattgttaaaaaaaatttggcarttatgaacagcacagtaatgaat

SEQ ID NO: 2097 - DNA, 47 bp, Homo Sapiens
  allele 24: 99-8499-107 : polymorphic base C or T
tttcaaggtcatcttttacaaaayggaatgtaaaagagttgttttgt

SEQ ID NO: 2098 - DNA, 47 bp, Homo Sapiens
  allele 24: 99-8505-269 : polymorphic base A or G
aggatttggaaaaaggaacagagrtagagggagacagatttctaatg

SEQ ID NO: 2099 - DNA, 47 bp, Homo Sapiens
  allele 24: 99-851-237 : polymorphic base C or T
tgcttttgtaacgttgggccataygacataggataatctctccatat

SEQ ID NO: 2100 - DNA, 47 bp, Homo Sapiens
  allele 24: 99-8510-44 : polymorphic base A or C
ccacttccctagtcccaaggaccmtgcctactcttcacccttctctc

SEQ ID NO: 2101 - DNA, 47 bp, Homo Sapiens
  allele 24: 99-8514-434 : polymorphic base C or T
ccaggtacagaggaaaggattacygaccaacagggatcaggaaagct

SEQ ID NO: 2102 - DNA, 47 bp, Homo Sapiens
  allele 24: 99-8530-209 : polymorphic base A or G
accaggaagatgataggctgatcrtggtcagcccagatagtaggaga

SEQ ID NO: 2103 - DNA, 47 bp, Homo Sapiens
  allele 24: 99-854-415 : polymorphic base C or T
atcagatagcttctgacaacagaytgccaaaaatattctcatctatc

SEQ ID NO: 2104 - DNA, 47 bp, Homo Sapiens
  allele 24: 99-8546-116 : polymorphic base C or T
ttgcaagcttggaattggctgctytagacttcttcagggcacagcaa

SEQ ID NO: 2105 - DNA, 47 bp, Homo Sapiens
  allele 24: 99-8571-396 : polymorphic base A or G
aatcataatataattacctcataragttgttgtgaggattaaatgag

SEQ ID NO: 2106 - DNA, 47 bp, Homo Sapiens
  allele 24: 99-8575-401 : polymorphic base C or T
tgatggaatgatgaagaagtgtgyctctgaaaacagtcatttttgaa

SEQ ID NO: 2107 - DNA, 47 bp, Homo Sapiens
  allele 24: 99-8576-321 : polymorphic base A or G
aactaaaattcccatttaaacacrgatattgttctctggaattttta

SEQ ID NO: 2108 - DNA, 47 bp, Homo Sapiens
  allele 24: 99-8578-407 : polymorphic base A or C
tttctcttttatgaaactactaamattgaagccattagtgttgtaaa

SEQ ID NO: 2109 - DNA, 47 bp, Homo Sapiens
  allele 24: 99-8581-443 : polymorphic base C or T
aaaggggcttccagagtcccatcygcagagaatgagtgcccagtacc

SEQ ID NO: 2110 - DNA, 47 bp, Homo Sapiens
  allele 24: 99-8583-146 : polymorphic base A or C
gccgaggagtaaatggtgcaggcmgagtaaaagaatcctcccctgcc

SEQ ID NO: 2111 - DNA, 47 bp, Homo Sapiens
  allele 24: 99-8588-369 : polymorphic base A or G
agtgaggagagaatgacataggarggagaattgagatggttaactgc

SEQ ID NO: 2112 - DNA, 47 bp, Homo Sapiens
  allele 24: 99-8590-287 : polymorphic base A or G
ttcttgcattatttctaaaatggrccataaaaaactatttcttaaat

SEQ ID NO: 2113 - DNA, 47 bp, Homo Sapiens
  allele 24: 99-860-419 : polymorphic base C or T
ggtttaaggaaatcttttctcacyttggccaaaaatcattgaatccc

SEQ ID NO: 2114 - DNA, 47 bp, Homo Sapiens
  allele 24: 99-8600-393 : polymorphic base A or T
tgaaaccaacacagaagaaagaawactgagaaaaggagattgagaga

SEQ ID NO: 2115 - DNA, 47 bp, Homo Sapiens
  allele 24: 99-8609-434 : polymorphic base G or T
aaggcttgccattgttcctgcaakgttaagtgcctgggttcgtccta

SEQ ID NO: 2116 - DNA, 47 bp, Homo Sapiens
  allele 24: 99-8611-383 : polymorphic base A or G
tttagaaattttgctttttgcacrctcacatttcgcaaaataacttg

SEQ ID NO: 2117 - DNA, 47 bp, Homo Sapiens
  allele 24: 99-862-233 : polymorphic base A or C
ttctaaggtaaacacagataaaamaactaaaaattatagccattagg

SEQ ID NO: 2118 - DNA, 47 bp, Homo Sapiens
  allele 24: 99-8626-133 : polymorphic base C or T
tctgaatgtcctcattattactgycttttgatttttataaaatcaag

SEQ ID NO: 2119 - DNA, 47 bp, Homo Sapiens
  allele 24: 99-8632-413 : polymorphic base A or G
agccttttgctctgtgaatgggcrgcagctgtggggactgaggcagg

SEQ ID NO: 2120 - DNA, 47 bp, Homo Sapiens
  allele 24: 99-8638-107 : polymorphic base C or T
gaaatgtccatgtggctggattcyggagactaacaagagaagtaaac

SEQ ID NO: 2121 - DNA, 47 bp, Homo Sapiens
  allele 24: 99-8641-418 : polymorphic base C or T
ctacctgtactctaaataagcgayaagcaaaatgaggtaaataacaa

SEQ ID NO: 2122 - DNA, 47 bp, Homo Sapiens
  allele 24: 99-8648-169 : polymorphic base A or T
aatagactttggagacatacagtwaagtggaggaagtaagttgcaga

SEQ ID NO: 2123 - DNA, 47 bp, Homo Sapiens
  allele 24: 99-8654-157 : polymorphic base A or G
atttctgctcttgagtttagtctrtgatgcattttgatgaaaaacaa

SEQ ID NO: 2124 - DNA, 47 bp, Homo Sapiens
  allele 24: 99-8655-77 : polymorphic base C or T
gaggaaatgtgtttaggtattatyagataatatatatgtgtctatgt

SEQ ID NO: 2125 - DNA, 47 bp, Homo Sapiens
  allele 24: 99-8658-168 : polymorphic base A or G
accaacaacagatgtgcaaacacrttatgggaaaaataatgaaagct

SEQ ID NO: 2126 - DNA, 47 bp, Homo Sapiens
  allele 24: 99-866-160 : polymorphic base C or T
gattagcagcctgcagtggatgcytatttaacacaatccatatacac

SEQ ID NO: 2127 - DNA, 47 bp, Homo Sapiens
  allele 24: 99-8662-192 : polymorphic base A or C
atgaatatactccctaattaagcmtattatatttgaaaatctttata

SEQ ID NO: 2128 - DNA, 47 bp, Homo Sapiens
  allele 24: 99-8663-39 : polymorphic base C or T
cccttaggaacattaaatatgcaygtgtactcaaaaacggtttataa

SEQ ID NO: 2129 - DNA, 47 bp, Homo Sapiens
  allele 24: 99-8665-182 : polymorphic base A or C
cacaggtcacaacttaaaccatcmcttcaagagacaggattatattt

SEQ ID NO: 2130 - DNA, 47 bp, Homo Sapiens
  allele 24: 99-8671-143 : polymorphic base A or G
ggggcggtgcttgtgctgtgcacrtctgaagctgtcgtagctgccac

SEQ ID NO: 2131 - DNA, 47 bp, Homo Sapiens
  allele 24: 99-8695-147 : polymorphic base A or T
agaaatatttcccaaattggactwgattatttgaagagcccttcaac

SEQ ID NO: 2132 - DNA, 47 bp, Homo Sapiens
  allele 24: 99-870-379 : polymorphic base C or T
gattattttctaaggaacgtctcyaatgaaagttgaaaatttacttc

SEQ ID NO: 2133 - DNA, 47 bp, Homo Sapiens
  allele 24: 99-8703-42 : polymorphic base C or T
cctttaaaatgcaacaggcttatyataaaagctaggctaggacatag

SEQ ID NO: 2134 - DNA, 47 bp, Homo Sapiens
  allele 24: 99-8715-315 : polymorphic base A or G
tgacctttatattttgagcctccrtttgctcacttgtaacatgggat

SEQ ID NO: 2135 - DNA, 47 bp, Homo Sapiens
  allele 24: 99-8725-240 : polymorphic base A or G
aggcaggtgttatttttagttatraattaggtgtcctgggatgtaca

SEQ ID NO: 2136 - DNA, 47 bp, Homo Sapiens
  allele 24: 99-8732-105 : polymorphic base A or G
ttcaatgattcatctcaaaatgargctgtaacttaagtggcattaaa

SEQ ID NO: 2137 - DNA, 47 bp, Homo Sapiens
  allele 24: 99-8744-283 : polymorphic base A or G
atagaaacaaggagacttgcccarggtcgtgcatcaattaagtgcct

SEQ ID NO: 2138 - DNA, 47 bp, Homo Sapiens
  allele 24: 99-8748-239 : polymorphic base C or T
caaaaaattcccacacaggagaayattattgatgtttccaaaactca

SEQ ID NO: 2139 - DNA, 47 bp, Homo Sapiens
  allele 24: 99-8755-402 : polymorphic base C or T
attctaccaaatactatgaaggaygagaataaggtgctgagaaagaa

SEQ ID NO: 2140 - DNA, 47 bp, Homo Sapiens
  allele 24: 99-8761-163 : polymorphic base A or G
cccaactcagggaccccctgctcrccacccagctgggacgcttggta

SEQ ID NO: 2141 - DNA, 47 bp, Homo Sapiens
  allele 24: 99-8775-410 : polymorphic base C or T
gcagcatggggctcagtaatgttygttggatgaatgaacacaactaa

SEQ ID NO: 2142 - DNA, 47 bp, Homo Sapiens
  allele 24: 99-8778-416 : polymorphic base A or G
ttgaggatgtttgaggaaattatrtaatctcacttgtaaaagaaaaa

SEQ ID NO: 2143 - DNA, 47 bp, Homo Sapiens
  allele 24: 99-8780-454 : polymorphic base C or T
agccccagatttaaagctatgtayctagactgtgttctactctgytc

SEQ ID NO: 2144 - DNA, 47 bp, Homo Sapiens
  allele 24: 99-8796-142 : polymorphic base G or T
atgaaaactcagcagcagccacakaaattgttgagaactcagaccag

SEQ ID NO: 2145 - DNA, 47 bp, Homo Sapiens
  allele 24: 99-8799-211 : polymorphic base A or G
ttaatttctggaatgaacagaaarattactagctctggctgattgac

SEQ ID NO: 2146 - DNA, 47 bp, Homo Sapiens
  allele 24: 99-88-216 : polymorphic base A or G
caagccagctgggtgacctctgarcccatccctaaccagctgtgtaa

SEQ ID NO: 2147 - DNA, 47 bp, Homo Sapiens
  allele 24: 99-8800-250 : polymorphic base C or T
attaagagtattacacataagtayggtatggaaagctttgaggctgt

SEQ ID NO: 2148 - DNA, 47 bp, Homo Sapiens
  allele 24: 99-8802-119 : polymorphic base A or G
tgtttaaattatattattgtgaartgaagaaaattgttctcttctga

SEQ ID NO: 2149 - DNA, 47 bp, Homo Sapiens
  allele 24: 99-8804-83 : polymorphic base A or C
aagtgccatcaacaccagatgtamgtacttgataagtgctgagagta

SEQ ID NO: 2150 - DNA, 47 bp, Homo Sapiens
  allele 24: 99-8812-220 : polymorphic base A or G
gtcctagaatttcaggagtctctractaatccacttagttttcggtg

SEQ ID NO: 2151 - DNA, 47 bp, Homo Sapiens
  allele 24: 99-8827-400 : polymorphic base C or T
tctatttttactttattttctacyaactgtgattttactttaaccca

SEQ ID NO: 2152 - DNA, 47 bp, Homo Sapiens
  allele 24: 99-8831-41 : polymorphic base C or T
ggctttacgtgaaagaataaattyttacttgctcccagggaccggct

SEQ ID NO: 2153 - DNA, 47 bp, Homo Sapiens
  allele 24: 99-8835-400 : polymorphic base A or G
tcttctaggctacctgaaaaaacratttatttcacttttcgtaatct

SEQ ID NO: 2154 - DNA, 47 bp, Homo Sapiens
  allele 24: 99-8849-167 : polymorphic base A or G
atcactcagccaattagacatcartccaggaccaatctcacccttga

SEQ ID NO: 2155 - DNA, 47 bp, Homo Sapiens
  allele 24: 99-8857-96 : polymorphic base A or T
ttattgaaaagttcttttagacawacttatccaaataattttactgt

SEQ ID NO: 2156 - DNA, 47 bp, Homo Sapiens
  allele 24: 99-8866-150 : polymorphic base A or G
ttaggaggcagtaggtcttacgcragaccatttccacttacataata

SEQ ID NO: 2157 - DNA, 47 bp, Homo Sapiens
  allele 24: 99-8867-278 : polymorphic base A or T
atatatccaactcctgaaaagacwaaagttcttagtttcctacttgc

SEQ ID NO: 2158 - DNA, 47 bp, Homo Sapiens
  allele 24: 99-8872-391 : polymorphic base A or T
tttagtgatcttctaaaacaatawcaaaagaaccccagatttttatt

SEQ ID NO: 2159 - DNA, 47 bp, Homo Sapiens
  allele 24: 99-8885-447 : polymorphic base A or G
tcttataactctactctgataccrccatgctaggaagaagctgggat

SEQ ID NO: 2160 - DNA, 47 bp, Homo Sapiens
  allele 24: 99-8887-397 : polymorphic base A or G
atgggacatcatttttattttaargaatgacagacaaaatatggtta

SEQ ID NO: 2161 - DNA, 47 bp, Homo Sapiens
  allele 24: 99-8894-123 : polymorphic base A or G
attgaataaaataatacaatgaartccacagcaatattaataggcag

SEQ ID NO: 2162 - DNA, 47 bp, Homo Sapiens
  allele 24: 99-8895-272 : polymorphic base A or T
attctaaaaaagctttagatgggwctgccatgacaataggcataggt

SEQ ID NO: 2163 - DNA, 47 bp, Homo Sapiens
  allele 24: 99-8901-283 : polymorphic base A or G
tgaggtatgaattgtagctgtccraggtagaaagctcatgccaggga

SEQ ID NO: 2164 - DNA, 47 bp, Homo Sapiens
  allele 24: 99-8905-184 : polymorphic base G or C
aatgaattcataaatgtgaagagstaacacatcactagagatatatg

SEQ ID NO: 2165 - DNA, 47 bp, Homo Sapiens
  allele 24: 99-8910-170 : polymorphic base C or T
gtcccaaggaccttctacgtcagyggcagaggtgggaggtgggctgg

SEQ ID NO: 2166 - DNA, 47 bp, Homo Sapiens
  allele 24: 99-8923-138 : polymorphic base C or T
tggttaattatgcaaccataagaygtgtagtttttaatataagtttc

SEQ ID NO: 2167 - DNA, 47 bp, Homo Sapiens
  allele 24: 99-8924-415 : polymorphic base A or T
tactgtattaacagcttaagtgawtcaacttttaaaatctgaaagta

SEQ ID NO: 2168 - DNA, 47 bp, Homo Sapiens
  allele 24: 99-8960-426 : polymorphic base A or C
tcttccacttggtaattcacattmattttaaggagcaacctcgccat

SEQ ID NO: 2169 - DNA, 47 bp, Homo Sapiens
  allele 24: 99-8963-409 : polymorphic base A or C
tgactatgatcttggggaaattamattatttctgtaaaatgagtctg

SEQ ID NO: 2170 - DNA, 47 bp, Homo Sapiens
  allele 24: 99-8974-386 : polymorphic base C or T
gatcatatatacagaactataacygtataattttaagatgtaattat

SEQ ID NO: 2171 - DNA, 47 bp, Homo Sapiens
  allele 24: 99-8978-52 : polymorphic base A or G
agtttgttctattatttgcgtgcrtcttaaaacacccaaatcagatc

SEQ ID NO: 2172 - DNA, 47 bp, Homo Sapiens
  allele 24: 99-8992-43 : polymorphic base A or G
tggcaagagtcatgccaaggaccrgcaccctaagagtgtttctcccc

SEQ ID NO: 2173 - DNA, 47 bp, Homo Sapiens
  allele 24: 99-9015-255 : polymorphic base A or G
tggctctgacctctcattaaatgrgatttgggctgtcaaggagtcac

SEQ ID NO: 2174 - DNA, 47 bp, Homo Sapiens
  allele 24: 99-9020-110 : polymorphic base G or T
caggttatctgaaactccagacgkggtgatacatgtaaaatgcgttg

SEQ ID NO: 2175 - DNA, 47 bp, Homo Sapiens
  allele 24: 99-9026-273 : polymorphic base A or G
aatactgaaactatttagataaarctgctgttgctggggtaattttt

SEQ ID NO: 2176 - DNA, 47 bp, Homo Sapiens
  allele 24: 99-9029-132 : polymorphic base A or G
acaaacctggtactttaaattctrtaccaaaactgagttaataattc

SEQ ID NO: 2177 - DNA, 47 bp, Homo Sapiens
  allele 24: 99-9047-183 : polymorphic base A or G
aataatggcaacacacaaacaacrgaatgacgtatttaaagttttga

SEQ ID NO: 2178 - DNA, 47 bp, Homo Sapiens
  allele 24: 99-9053-311 : polymorphic base A or C
aagaccctcaggtatcattcaagmgtgtaggaaatctgaactcattt

SEQ ID NO: 2179 - DNA, 47 bp, Homo Sapiens
  allele 24: 99-9059-197 : polymorphic base A or T
gcaaaataagcatgagggagtggwtatggaatgatgggtggggcaaa

SEQ ID NO: 2180 - DNA, 47 bp, Homo Sapiens
  allele 24: 99-9061-309 : polymorphic base A or G
ataaacaaaccttctgctgctaarctgtgttttcttctaggatttgg

SEQ ID NO: 2181 - DNA, 47 bp, Homo Sapiens
  allele 24: 99-9064-194 : polymorphic base A or G
aacttttgcgattggttttcttgrctcagcatgattctctgcacatt

SEQ ID NO: 2182 - DNA, 47 bp, Homo Sapiens
  allele 24: 99-9079-158 : polymorphic base A or G
tataataggaaaattcatcatagrttttaacacttgcttttatgata

SEQ ID NO: 2183 - DNA, 47 bp, Homo Sapiens
  allele 24: 99-9084-200 : polymorphic base A or G
gactgtgtgagggtggtctctccrgttgcttttggggatctggtccc

SEQ ID NO: 2184 - DNA, 47 bp, Homo Sapiens
  allele 24: 99-9092-167 : polymorphic base A or G
ctaatcagaatattctttaatatrcctacaaaagaagttgaattcat

SEQ ID NO: 2185 - DNA, 47 bp, Homo Sapiens
  allele 24: 99-9097-342 : polymorphic base A or G
atgctaggaataacattgaatagrtaccaatagtacctggtgagaga

SEQ ID NO: 2186 - DNA, 47 bp, Homo Sapiens
  allele 24: 99-9105-68 : polymorphic base G or T
tgaacctgagcaggctctttgagkctccattttcttacttgtaaaat

SEQ ID NO: 2187 - DNA, 47 bp, Homo Sapiens
  allele 24: 99-9118-393 : polymorphic base C or T
agatccaaggtgccctgaatataygctttgcttagcagcagttacaa

SEQ ID NO: 2188 - DNA, 47 bp, Homo Sapiens
  allele 24: 99-9120-197 : polymorphic base C or T
tgtcaagctgtaaaattgcagctygatccttcagaagtgggttacaa

SEQ ID NO: 2189 - DNA, 47 bp, Homo Sapiens
  allele 24: 99-9126-25 : polymorphic base G or C
caggggggataaaaattggccaascaagctgttcaactgcaatatca

SEQ ID NO: 2190 - DNA, 47 bp, Homo Sapiens
  allele 24: 99-913-140 : polymorphic base A or G
gtcatggggtccagggccatgcartcccctgccccaaagaagtgggc

SEQ ID NO: 2191 - DNA, 47 bp, Homo Sapiens
  allele 24: 99-9141-307 : polymorphic base G or C
agtaaacttagtgaaatataaaastaaaaatatattttgtagaaata

SEQ ID NO: 2192 - DNA, 47 bp, Homo Sapiens
  allele 24: 99-9152-154 : polymorphic base C or T
gtcatttattcaacaaatacttaytgttctatatcaggcattgtggg

SEQ ID NO: 2193 - DNA, 47 bp, Homo Sapiens
  allele 24: 99-9157-329 : polymorphic base A or C
acagggcatcaaaaccatgacaamacgagagtgaagagaagtccacc

SEQ ID NO: 2194 - DNA, 47 bp, Homo Sapiens
  allele 24: 99-9175-329 : polymorphic base A or G
aggattgtaggtcagaattctggracatctatgaaagacttacttaa

SEQ ID NO: 2195 - DNA, 47 bp, Homo Sapiens
  allele 24: 99-9204-245 : polymorphic base C or T
aaactttgcggcataacacaatayaaatgtattatccttgcagacct

SEQ ID NO: 2196 - DNA, 47 bp, Homo Sapiens
  allele 24: 99-921-285 : polymorphic base C or T
taaattgcacaagatgatagtcayggaaatagtaagcaatttttttt

SEQ ID NO: 2197 - DNA, 47 bp, Homo Sapiens
  allele 24: 99-924-93 : polymorphic base A or G
tgcatatctggaaaggacttgtcrtatgaatgttaattgttatttac

SEQ ID NO: 2198 - DNA, 47 bp, Homo Sapiens
  allele 24: 99-9240-109 : polymorphic base C or T
accctggacaaaagtgtccactaytaaatttctgggtcttcatctgt

SEQ ID NO: 2199 - DNA, 47 bp, Homo Sapiens
  allele 24: 99-9250-450 : polymorphic base G or T
gagagccacggggaatctacatakctccccctgggggatgaagcagt

SEQ ID NO: 2200 - DNA, 47 bp, Homo Sapiens
  allele 24: 99-9254-404 : polymorphic base A or G
atctgcattcgcctaataatctcrtattcactcccttcatcttagat

SEQ ID NO: 2201 - DNA, 47 bp, Homo Sapiens
  allele 24: 99-926-98 : polymorphic base G or T
caaagttatctttgtatcatacakgtacacttaaaaaaaatatatta

SEQ ID NO: 2202 - DNA, 47 bp, Homo Sapiens
  allele 24: 99-9263-283 : polymorphic base A or G
cacttctgatgggagcacagagcrgacagctgaagccatgggaatgg

SEQ ID NO: 2203 - DNA, 47 bp, Homo Sapiens
  allele 24: 99-9271-70 : polymorphic base G or T
ggatcctaaaaattaatactaggkgtatattttcaaattacatagtc

SEQ ID NO: 2204 - DNA, 47 bp, Homo Sapiens
  allele 24: 99-9274-246 : polymorphic base C or T
aagattgtttaatccaatcctctyacttcacgaatgaagaaactggg

SEQ ID NO: 2205 - DNA, 47 bp, Homo Sapiens
  allele 24: 99-9276-163 : polymorphic base C or T
tcactaggaacaggctggcttgaygaaatggaagaatcaacattgtc

SEQ ID NO: 2206 - DNA, 47 bp, Homo Sapiens
  allele 24: 99-9355-134 : polymorphic base C or T
gcagtgatgttgtaattatcagaycataaatttaaaacaactataac

SEQ ID NO: 2207 - DNA, 47 bp, Homo Sapiens
  allele 24: 99-9368-223 : polymorphic base A or G
tttctggtccggaagaaggcaccrcacatggtctccttgctgacaag

SEQ ID NO: 2208 - DNA, 47 bp, Homo Sapiens
  allele 24: 99-937-125 : polymorphic base A or T
tcaaacatctaaagaaaacatttwaaaaaaagtcagaaaccttaggc

SEQ ID NO: 2209 - DNA, 47 bp, Homo Sapiens
  allele 24: 99-9372-298 : polymorphic base A or C
ttcttctttatcctgttgatgtamtggattacattaattgattttca

SEQ ID NO: 2210 - DNA, 47 bp, Homo Sapiens
  allele 24: 99-9381-429 : polymorphic base A or G
ccagctttttcatcaaaccaaatrgtatcctcctaagcagcccaggg

SEQ ID NO: 2211 - DNA, 47 bp, Homo Sapiens
  allele 24: 99-9385-387 : polymorphic base C or T
aaaatctttcattaaaatttagayaaatgcagcttatattttctaca

SEQ ID NO: 2212 - DNA, 47 bp, Homo Sapiens
  allele 24: 99-9389-363 : polymorphic base A or G
attaacttcattttgtaattgagraatttaaagttcagagagatatg

SEQ ID NO: 2213 - DNA, 47 bp, Homo Sapiens
  allele 24: 99-9395-133 : polymorphic base C or T
acggggcacgctcaggggagctgygctgcagcctcgtcagcttccag

SEQ ID NO: 2214 - DNA, 47 bp, Homo Sapiens
  allele 24: 99-9401-80 : polymorphic base A or G
gcattttggtctgttggtggctgrcatttggatttttaattttactt

SEQ ID NO: 2215 - DNA, 47 bp, Homo Sapiens
  allele 24: 99-9402-263 : polymorphic base C or T
gatctccatttatccttgatcctyataattcctactgatagtgttgt

SEQ ID NO: 2216 - DNA, 47 bp, Homo Sapiens
  allele 24: 99-9404-338 : polymorphic base A or T
aaagtgatgtattacaaagggatwtatacagacattgtaccactgaa

SEQ ID NO: 2217 - DNA, 47 bp, Homo Sapiens
  allele 24: 99-9405-421 : polymorphic base A or G
gtagcttcaacatttctcatgcaratttatctggagcgcagaagtct

SEQ ID NO: 2218 - DNA, 47 bp, Homo Sapiens
  allele 24: 99-941-265 : polymorphic base A or T
taattgtgtcccagtaaatacttwtggaaagtcaattttgaatttga

SEQ ID NO: 2219 - DNA, 47 bp, Homo Sapiens
  allele 24: 99-9410-205 : polymorphic base C or T
tcattggactcctgcttcatcttytcaactctggtggtttccagaga

SEQ ID NO: 2220 - DNA, 47 bp, Homo Sapiens
  allele 24: 99-9412-202 : polymorphic base C or T
ctttataaaaagacaacctgctayatacatacaatatacaatatgta

SEQ ID NO: 2221 - DNA, 47 bp, Homo Sapiens
  allele 24: 99-9417-151 : polymorphic base C or T
aaggttacttcttggttaaaaatytaagtaatctggaggatatcata

SEQ ID NO: 2222 - DNA, 47 bp, Homo Sapiens
  allele 24: 99-942-381 : polymorphic base C or T
tttaaatatgcgaccttagtctgyactgaatgtaaagaataccattt

SEQ ID NO: 2223 - DNA, 47 bp, Homo Sapiens
  allele 24: 99-9420-318 : polymorphic base C or T
tatataatacaacaaactactaayccaaacagtgtttgccttcttta

SEQ ID NO: 2224 - DNA, 47 bp, Homo Sapiens
  allele 24: 99-9421-51 : polymorphic base A or G
cctgctgtatctcatgggttgttrtgaggatcacatgtgataataaa

SEQ ID NO: 2225 - DNA, 47 bp, Homo Sapiens
  allele 24: 99-9422-41 : polymorphic base A or G
gtgtgtcctcttcaattttttgcrtcagtattttatagttttcatag

SEQ ID NO: 2226 - DNA, 47 bp, Homo Sapiens
  allele 24: 99-9423-394 : polymorphic base A or G
agaggaatggggcaacttggagargttggtttgcaaaggcttctctg

SEQ ID NO: 2227 - DNA, 47 bp, Homo Sapiens
  allele 24: 99-9424-229 : polymorphic base A or G
tctcagcttccattcggttaatcraatgcagtgtgcttaggtcaact

SEQ ID NO: 2228 - DNA, 47 bp, Homo Sapiens
  allele 24: 99-9427-454 : polymorphic base C or T
tagatcagtgacattcatgactayaacactcttgatttgactatttc

SEQ ID NO: 2229 - DNA, 47 bp, Homo Sapiens
  allele 24: 99-9446-394 : polymorphic base A or G
gcagaagtcagaagatcaaaaacrgtttcactggaccaaagtcagta

SEQ ID NO: 2230 - DNA, 47 bp, Homo Sapiens
  allele 24: 99-9448-292 : polymorphic base C or T
gcaggcccagctccttgtctaaaytcagcagttagaaagttatttct

SEQ ID NO: 2231 - DNA, 47 bp, Homo Sapiens
  allele 24: 99-9462-362 : polymorphic base A or G
aatctcagggcagggtggagaatraaagtgtcaaccttttaaaaggc

SEQ ID NO: 2232 - DNA, 47 bp, Homo Sapiens
  allele 24: 99-9471-230 : polymorphic base A or G
tcactgggaccactcacccatgcrgcaaaactgggggcagagggcag

SEQ ID NO: 2233 - DNA, 47 bp, Homo Sapiens
  allele 24: 99-949-214 : polymorphic base A or G
aatgttatggtatttggagatacrgcttttggaaggtaactactcct

SEQ ID NO: 2234 - DNA, 47 bp, Homo Sapiens
  allele 24: 99-9491-388 : polymorphic base A or G
caatgatcacattacatgtacatragattgcagctgtgattgtggct

SEQ ID NO: 2235 - DNA, 47 bp, Homo Sapiens
  allele 24: 99-9493-455 : polymorphic base G or C
gctgctctcagagtatacactaasaagttatcatgcttcacaaatat

SEQ ID NO: 2236 - DNA, 47 bp, Homo Sapiens
  allele 24: 99-9499-111 : polymorphic base A or T
attaagtaacaactgcagattacwcaagggtaaacactgctgctaat

SEQ ID NO: 2237 - DNA, 47 bp, Homo Sapiens
  allele 24: 99-950-418 : polymorphic base C or T
gagatagcaatcaaatgttttatytgaacttcgaaatttttaagcaa

SEQ ID NO: 2238 - DNA, 47 bp, Homo Sapiens
  allele 24: 99-9513-285 : polymorphic base A or G
tcagtggcttatcaccgaattacrcgaaattgtttggtaaaggaaca

SEQ ID NO: 2239 - DNA, 47 bp, Homo Sapiens
  allele 24: 99-952-252 : polymorphic base G or C
ctcaccataccgaattactgtgtstgtgaatcttgtcaacaatccat

SEQ ID NO: 2240 - DNA, 47 bp, Homo Sapiens
  allele 24: 99-9527-211 : polymorphic base C or T
tattaatgttctgattatgcctayattccttctacaaatatatatgg

SEQ ID NO: 2241 - DNA, 47 bp, Homo Sapiens
  allele 24: 99-9531-340 : polymorphic base C or T
ttaggaaattgagaaatatctttygctttttatgactcaattctttt

SEQ ID NO: 2242 - DNA, 47 bp, Homo Sapiens
  allele 24: 99-9538-395 : polymorphic base A or G
gattattagacattattttgagtrtaaaatgtaaaatattatttgag

SEQ ID NO: 2243 - DNA, 47 bp, Homo Sapiens
  allele 24: 99-954-45 : polymorphic base A or C
atctttggtggataaaatgggagmccacagtatatatttattaaact

SEQ ID NO: 2244 - DNA, 47 bp, Homo Sapiens
  allele 24: 99-9542-164 : polymorphic base G or T
tgttttcacagaacataaatgctkcaatttatttattagtttaatgt

SEQ ID NO: 2245 - DNA, 47 bp, Homo Sapiens
  allele 24: 99-9545-100 : polymorphic base A or C
accccacaggaattctgggattcmatgagctataaagatggttcaca

SEQ ID NO: 2246 - DNA, 47 bp, Homo Sapiens
  allele 24: 99-9554-345 : polymorphic base A or C
gcatgaaagggcaaaaaagggacmctgaactaactcagaaatggtaa

SEQ ID NO: 2247 - DNA, 47 bp, Homo Sapiens
  allele 24: 99-9555-348 : polymorphic base C or T
tgaacagtaaggatacagcacagyaaggaatctgtatgagtcgggaa

SEQ ID NO: 2248 - DNA, 47 bp, Homo Sapiens
  allele 24: 99-9556-349 : polymorphic base A or G
aacattggcctcctttagagcatrttcttctcccagcatccagcatt

SEQ ID NO: 2249 - DNA, 47 bp, Homo Sapiens
  allele 24: 99-9567-229 : polymorphic base C or T
tttactttttaaaatttcactcaygtatgactagacttctcatgatt

SEQ ID NO: 2250 - DNA, 47 bp, Homo Sapiens
  allele 24: 99-9572-240 : polymorphic base C or T
atccccccattcacaagacagctyttggatgtttgtggaagactctc

SEQ ID NO: 2251 - DNA, 47 bp, Homo Sapiens
  allele 24: 99-9577-284 : polymorphic base C or T
gagaggtcaagaaatgccacttcyctgttgatgctcccaaggacaag

SEQ ID NO: 2252 - DNA, 47 bp, Homo Sapiens
  allele 24: 99-9579-363 : polymorphic base G or C
tagtcctggtggagtaagcccatsgaagaactaggctgtaaggtgtc

SEQ ID NO: 2253 - DNA, 47 bp, Homo Sapiens
  allele 24: 99-958-92 : polymorphic base C or T
tttgtggtaggagtttaatatgaycatggtactacaaaataggggat

SEQ ID NO: 2254 - DNA, 47 bp, Homo Sapiens
  allele 24: 99-9587-338 : polymorphic base A or G
gatctcaatagaaatataaaaacrtttgaaaatatccaacatacatt

SEQ ID NO: 2255 - DNA, 47 bp, Homo Sapiens
  allele 24: 99-961-150 : polymorphic base C or T
tgatgttatgctgatatgcaacaygttaaactgttaacttccacata

SEQ ID NO: 2256 - DNA, 47 bp, Homo Sapiens
  allele 24: 99-963-395 : polymorphic base A or G
ctacacattgtgcacattcctggraataactgatgcttttgtctcat

SEQ ID NO: 2257 - DNA, 47 bp, Homo Sapiens
  allele 24: 99-965-165 : polymorphic base C or T
ctatattctattctgtttatttaycttccctttatgccaagggtagg

SEQ ID NO: 2258 - DNA, 47 bp, Homo Sapiens
  allele 24: 99-967-306 : polymorphic base C or T
tttaaccactgacagtgaggattyaggtctctattttaataaactgt

SEQ ID NO: 2259 - DNA, 47 bp, Homo Sapiens
  allele 24: 99-976-246 : polymorphic base C or T
acaccattttgtcaaaacctatcyctcccattctataacctaaagat

SEQ ID NO: 2260 - DNA, 47 bp, Homo Sapiens
  allele 24: 99-979-343 : polymorphic base A or C
atataaaatcaccaaacaaaatgmaaagacgttttgtttgtttttgt

SEQ ID NO: 2261 - DNA, 47 bp, Homo Sapiens
  allele 24: 99-10000-518 : polymorphic base G or A
aaaatctagtggatgagcctagaragaaacctgaggaatctgataag

SEQ ID NO: 2262 - DNA, 47 bp, Homo Sapiens
  allele 24: 99-10016-115 : polymorphic base T or A
aatatctaaacatattattctgawatataaaaactgacttataaatc

SEQ ID NO: 2263 - DNA, 47 bp, Homo Sapiens
  allele 24: 99-10027-378 : polymorphic base G or A
cctagaatgctcttcctacagttrtctgcttggttgactactcaatg

SEQ ID NO: 2264 - DNA, 47 bp, Homo Sapiens
  allele 24: 99-10028-93 : polymorphic base C or G
ttttatagtagatccaaatttggsttaactttttgcaaagacatttt

SEQ ID NO: 2265 - DNA, 47 bp, Homo Sapiens
  allele 24: 99-10031-130 : polymorphic base T or C
tgtattactttaggcagaagaacycctctctcaaacattcaatactt

SEQ ID NO: 2266 - DNA, 47 bp, Homo Sapiens
  allele 24: 99-10046-199 : polymorphic base T or C
aacatttaccatctgtgttttgcyagacagacatgctgtaaataacc

SEQ ID NO: 2267 - DNA, 47 bp, Homo Sapiens
  allele 24: 99-10064-252 : polymorphic base T or C
acttctttagttgttattgacatygagcaaagaattttacttatgtt

SEQ ID NO: 2268 - DNA, 47 bp, Homo Sapiens
  allele 24: 99-10066-465 : polymorphic base G or T
aaataacttagcatgtaaattaakaaaataatatatcactataatat

SEQ ID NO: 2269 - DNA, 47 bp, Homo Sapiens
  allele 24: 99-10067-168 : polymorphic base G or A
aaggtgtgatgtacactggaaatrtttgatgaaagaacatggggaag

SEQ ID NO: 2270 - DNA, 47 bp, Homo Sapiens
  allele 24: 99-10078-341 : polymorphic base T or C
gaattccaagggttatggtttgcytcctgccaaccatctccactatg

SEQ ID NO: 2271 - DNA, 47 bp, Homo Sapiens
  allele 24: 99-10104-464 : polymorphic base C or A
caaacaagatcatttatattatamctattataattgagttaatttat

SEQ ID NO: 2272 - DNA, 47 bp, Homo Sapiens
  allele 24: 99-10106-247 : polymorphic base G or T
aagataaattttccttaaaacctktctttgcaacttcttctctaata

SEQ ID NO: 2273 - DNA, 47 bp, Homo Sapiens
  allele 24: 99-10108-419 : polymorphic base G or A
gcagaggttctcaaggggatcacrtaaagagtagctttttggaaaat

SEQ ID NO: 2274 - DNA, 47 bp, Homo Sapiens
  allele 24: 99-10118-323 : polymorphic base T or C
gaaaaatgaagagaagaaagaaayattcagaacactggacaagtcat

SEQ ID NO: 2275 - DNA, 47 bp, Homo Sapiens
  allele 24: 99-10126-413 : polymorphic base C or T
ggccatgggctgcttaaccaatayattaggtggtagtggaagtgaca

SEQ ID NO: 2276 - DNA, 47 bp, Homo Sapiens
  allele 24: 99-10127-506 : polymorphic base A or T
tcttacccaaggccaccaaggcgwtacttctactagtctgcaagagc

SEQ ID NO: 2277 - DNA, 47 bp, Homo Sapiens
  allele 24: 99-10137-195 : polymorphic base T or G
gagagctttgcccttgtcctcatkaacttttatgtcaatacattcaa

SEQ ID NO: 2278 - DNA, 47 bp, Homo Sapiens
  allele 24: 99-10142-293 : polymorphic base G or A
atcccttcctaacttggttacaartttcttcaaaataaaatagcatt

SEQ ID NO: 2279 - DNA, 47 bp, Homo Sapiens
  allele 24: 99-10143-111 : polymorphic base A or G
ttaatcattttctttcaccttccrgcataggtataagtattaaacca

SEQ ID NO: 2280 - DNA, 47 bp, Homo Sapiens
  allele 24: 99-10146-202 : polymorphic base T or A
aagagtgttcgtaaatttcagaawtatatgcatttttgtttatgttt

SEQ ID NO: 2281 - DNA, 47 bp, Homo Sapiens
  allele 24: 99-10149-291 : polymorphic base T or C
tctcatctgcaaccattacacttygacctactccacaaaaaccctag

SEQ ID NO: 2282 - DNA, 47 bp, Homo Sapiens
  allele 24: 99-10151-340 : polymorphic base G or A
gagctgactcaacttgtcgtggcrtcaagattcaggatcagaggtta

SEQ ID NO: 2283 - DNA, 47 bp, Homo Sapiens
  allele 24: 99-10153-267 : polymorphic base A or G
agaactaaggggaggaaggacaarataggtgctatagatgtggaaga

SEQ ID NO: 2284 - DNA, 47 bp, Homo Sapiens
  allele 24: 99-10155-423 : polymorphic base C or G
cgtgagagcccgttggtccccaastctctctacccctggctctcagc

SEQ ID NO: 2285 - DNA, 47 bp, Homo Sapiens
  allele 24: 99-10173-122 : polymorphic base A or G
attttccctgtatgtgcatgaagrcagacatacagaaaaacaaacaa

SEQ ID NO: 2286 - DNA, 47 bp, Homo Sapiens
  allele 24: 99-10179-48 : polymorphic base G or A
aggccttaaacaaagaatgagtartaacttacacttaatgaaatata

SEQ ID NO: 2287 - DNA, 47 bp, Homo Sapiens
  allele 24: 99-1018-244 : polymorphic base A or C
ttccctcacagagattctgtgagmcttgtttgcttcctaaatgttag

SEQ ID NO: 2288 - DNA, 47 bp, Homo Sapiens
  allele 24: 99-10183-166 : polymorphic base G or T
gaaatcaaatagcataatgctccktgatggcatagtttcttctcaca

SEQ ID NO: 2289 - DNA, 47 bp, Homo Sapiens
  allele 24: 99-10185-402 : polymorphic base C or A
ttaatttttctattaacttttgamgattagatatttaaataagacaa

SEQ ID NO: 2290 - DNA, 47 bp, Homo Sapiens
  allele 24: 99-10188-116 : polymorphic base G or A
ctctgccattgtaacatacagccrtggacagtaaaagtatgactgtg

SEQ ID NO: 2291 - DNA, 47 bp, Homo Sapiens
  allele 24: 99-10201-115 : polymorphic base C or T
ctcaacattactactatagtctaygtggttaagtattttaaaacaat

SEQ ID NO: 2292 - DNA, 47 bp, Homo Sapiens
  allele 24: 99-10207-173 : polymorphic base A or G
gatttgttatgcaacaataaatgrtaagtctaaaattcagacttctc

SEQ ID NO: 2293 - DNA, 47 bp, Homo Sapiens
  allele 24: 99-10211-380 : polymorphic base A or G
cttcctctggccccctcttccccrtgcagtaactgactcaccatctc

SEQ ID NO: 2294 - DNA, 47 bp, Homo Sapiens
  allele 24: 99-10216-336 : polymorphic base A or C
tgttgtagactcagcactgctgtmcaatagaactttctgtgatgata

SEQ ID NO: 2295 - DNA, 47 bp, Homo Sapiens
  allele 24: 99-10220-312 : polymorphic base C or A
agattcttcctcttgtattttttmttgttctcatctggaatctggaa

SEQ ID NO: 2296 - DNA, 47 bp, Homo Sapiens
  allele 24: 99-10223-153 : polymorphic base T or A
aagcatttacgaaaccatgtaacwgccaaagaatggatgttaaagca

SEQ ID NO: 2297 - DNA, 47 bp, Homo Sapiens
  allele 24: 99-10224-223 : polymorphic base T or A
tttgcatcaacctacttaaattawttttgctttattgctaacaggta

SEQ ID NO: 2298 - DNA, 47 bp, Homo Sapiens
  allele 24: 99-10234-334 : polymorphic base A or G
aaattatgtctgaatttttttcargattatacaaaaagtcactaaaa

SEQ ID NO: 2299 - DNA, 47 bp, Homo Sapiens
  allele 24: 99-1024-403 : polymorphic base G or A
cccacagttaaatataaaaacccrcctaccctagggctggtgaggtg

SEQ ID NO: 2300 - DNA, 47 bp, Homo Sapiens
  allele 24: 99-10245-197 : polymorphic base A or G
tgtaaacacctttgaaaaacaccratatagtgaaagaacctaatttt

SEQ ID NO: 2301 - DNA, 47 bp, Homo Sapiens
  allele 24: 99-10256-41 : polymorphic base A or G
aagccaggcagctgggtgatgccracaggctgattaggttgacatat

SEQ ID NO: 2302 - DNA, 47 bp, Homo Sapiens
  allele 24: 99-10264-82 : polymorphic base G or A
caggtcgagcatcccttgtttgaratgcaggggatcagaagtgtttt

SEQ ID NO: 2303 - DNA, 47 bp, Homo Sapiens
  allele 24: 99-10266-290 : polymorphic base T or A
tcctgccggcagtcccctcctacwggtctctctgggttccaggagcc

SEQ ID NO: 2304 - DNA, 47 bp, Homo Sapiens
  allele 24: 99-10267-409 : polymorphic base A or C
tccaggccacactcaccacggagmcccctgcctggcacagagcccag

SEQ ID NO: 2305 - DNA, 47 bp, Homo Sapiens
  allele 24: 99-10303-406 : polymorphic base C or T
ggccctcccatgccattcccaggycagcctgctcccagttcatcacc

SEQ ID NO: 2306 - DNA, 47 bp, Homo Sapiens
  allele 24: 99-10304-88 : polymorphic base A or G
cttgctgtcccttgaacacaccarcgatgaccccatctcagtgccct

SEQ ID NO: 2307 - DNA, 47 bp, Homo Sapiens
  allele 24: 99-10312-155 : polymorphic base C or T
ctttttgaagcctggtcccctgayggactattcagctccaacctccc

SEQ ID NO: 2308 - DNA, 47 bp, Homo Sapiens
  allele 24: 99-10318-230 : polymorphic base C or T
gcttattcagccatggataaatayatggaaacacattatatctgttc

SEQ ID NO: 2309 - DNA, 47 bp, Homo Sapiens
  allele 24: 99-10330-432 : polymorphic base G or A
taggagttgagcttatggatgctrtatgtcagacttggtgttaggcc

SEQ ID NO: 2310 - DNA, 47 bp, Homo Sapiens
  allele 24: 99-10332-89 : polymorphic base C or T
gatgctaatgcagagtgcattgaytagcagatgaccactgtgggctc

SEQ ID NO: 2311 - DNA, 47 bp, Homo Sapiens
  allele 24: 99-10345-182 : polymorphic base T or G
cagcatctagactcagcaggcggkaagtgccactctttcttgaaagg

SEQ ID NO: 2312 - DNA, 47 bp, Homo Sapiens
  allele 24: 99-10353-285 : polymorphic base G or T
atgtcacgaggaaggatttaactktgtagaaggaagttagcatcttt

SEQ ID NO: 2313 - DNA, 47 bp, Homo Sapiens
  allele 24: 99-10364-331 : polymorphic base A or G
tgttagaaaattgtttcaaaagtrcctaggttaaaaataccaactat

SEQ ID NO: 2314 - DNA, 47 bp, Homo Sapiens
  allele 24: 99-10369-41 : polymorphic base T or C
atcagcaaatcctggggggagagyggggctggagggcgaagaagccc

SEQ ID NO: 2315 - DNA, 47 bp, Homo Sapiens
  allele 24: 99-10374-343 : polymorphic base C or T
gattgttcttcccaattataaaaygtactttaatcccaaaacaattg

SEQ ID NO: 2316 - DNA, 47 bp, Homo Sapiens
  allele 24: 99-10381-328 : polymorphic base T or A
ttgtattcaaaattattataaagwacttttgcagttaaataataaga

SEQ ID NO: 2317 - DNA, 47 bp, Homo Sapiens
  allele 24: 99-10389-114 : polymorphic base G or T
cactcagcatctctgccacccctkgagcccatatggcattatacctt

SEQ ID NO: 2318 - DNA, 47 bp, Homo Sapiens
  allele 24: 99-10390-172 : polymorphic base A or G
gaaagtgtttgcctttatttgacrgcctgattactttaaggtgtcct

SEQ ID NO: 2319 - DNA, 47 bp, Homo Sapiens
  allele 24: 99-10414-128 : polymorphic base C or T
gtgaaggtgcagaacaatgtgcaygggcaatatgtgtactcacacaa

SEQ ID NO: 2320 - DNA, 47 bp, Homo Sapiens
  allele 24: 99-10434-121 : polymorphic base G or T
gctgcacacagaggcaccgtctgkcaggagctttctgggcctcatca

SEQ ID NO: 2321 - DNA, 47 bp, Homo Sapiens
  allele 24: 99-10436-162 : polymorphic base C or T
gttagttggaaatgtaagtataaygacaggtttcaggggagttaggg

SEQ ID NO: 2322 - DNA, 47 bp, Homo Sapiens
  allele 24: 99-10438-281 : polymorphic base C or A
agagtaacgattacctgagccctmggattcaggttgccagatgagat

SEQ ID NO: 2323 - DNA, 47 bp, Homo Sapiens
  allele 24: 99-10446-425 : polymorphic base G or C
ggacgtggccatggggctggggasgaatcaagtctagccaaatgatg

SEQ ID NO: 2324 - DNA, 47 bp, Homo Sapiens
  allele 24: 99-10451-188 : polymorphic base A or T
ggctatggacaaaggaagttatgwccctttttgccgataatttctgg

SEQ ID NO: 2325 - DNA, 47 bp, Homo Sapiens
  allele 24: 99-10452-306 : polymorphic base A or G
tggaaacagacagaaaggtagtargaaaatagaaaatggaatgagaa

SEQ ID NO: 2326 - DNA, 47 bp, Homo Sapiens
  allele 24: 99-10457-310 : polymorphic base T or C
caaaataatgatgaaccaaaagaygcagtggactctgcaagacaagt

SEQ ID NO: 2327 - DNA, 47 bp, Homo Sapiens
  allele 24: 99-10470-405 : polymorphic base A or C
tcaaagaagcacatcctagagtamgacttcccagccaagggaaactg

SEQ ID NO: 2328 - DNA, 47 bp, Homo Sapiens
  allele 24: 99-10471-88 : polymorphic base C or T
tttctatctgtggtttacattttytgactgtatgaatttaataattt

SEQ ID NO: 2329 - DNA, 47 bp, Homo Sapiens
  allele 24: 99-10473-259 : polymorphic base T or C
tctctcttcatcattatccaaaayataattaaaagatgacatttaaa

SEQ ID NO: 2330 - DNA, 47 bp, Homo Sapiens
  allele 24: 99-10474-223 : polymorphic base G or C
caattacttccaagatgacacggsagagaacatactgttacacgaat

SEQ ID NO: 2331 - DNA, 47 bp, Homo Sapiens
  allele 24: 99-10481-217 : polymorphic base C or T
tcaagaatgattctatctagtccycttcattacttataaataaatac

SEQ ID NO: 2332 - DNA, 47 bp, Homo Sapiens
  allele 24: 99-10487-57 : polymorphic base T or C
taaaaagacccttgtgattacatyactctcacccgtgtaatccagga

SEQ ID NO: 2333 - DNA, 47 bp, Homo Sapiens
  allele 24: 99-10488-146 : polymorphic base G or C
aggtgctagcaaagcacagtatgsaacagggtaaggttgatggaaca

SEQ ID NO: 2334 - DNA, 47 bp, Homo Sapiens
  allele 24: 99-10491-300 : polymorphic base C or T
aagataaaccactggagaagagaygaaaagttaccatggccagaaga

SEQ ID NO: 2335 - DNA, 47 bp, Homo Sapiens
  allele 24: 99-10499-102 : polymorphic base T or G
tgtgtgtgtgtgtgtgtgtgtgtktaaggaagaacaatttgtgctaa

SEQ ID NO: 2336 - DNA, 47 bp, Homo Sapiens
  allele 24: 99-10502-161 : polymorphic base T or C
aaaaatgtgagagcagtgaggtcygaggaggatgaactcagaaagca

SEQ ID NO: 2337 - DNA, 47 bp, Homo Sapiens
  allele 24: 99-10506-307 : polymorphic base A or C
agacaacgcccaccctcctgggamttggcaagcccaaggccatgcac

SEQ ID NO: 2338 - DNA, 47 bp, Homo Sapiens
  allele 24: 99-10507-216 : polymorphic base C or T
caatgtgcagaggagatagcacgyctgagcaggagaggggctacaga

SEQ ID NO: 2339 - DNA, 47 bp, Homo Sapiens
  allele 24: 99-10509-122 : polymorphic base T or G
ataccacccaagcatatcataatkaaactgattgaaaatcaaagata

SEQ ID NO: 2340 - DNA, 47 bp, Homo Sapiens
  allele 24: 99-1051-284 : polymorphic base G or A
aatctcccggttttaatgtttcaraacattgctcaggccatacaaaa

SEQ ID NO: 2341 - DNA, 47 bp, Homo Sapiens
  allele 24: 99-10513-347 : polymorphic base T or C
gtatgtgtcatagaattatgttayataaatgtatctataatatttta

SEQ ID NO: 2342 - DNA, 47 bp, Homo Sapiens
  allele 24: 99-10514-546 : polymorphic base G or T
ttctttccactgtaatggttgatkacagcagaagagctagcatgraa

SEQ ID NO: 2343 - DNA, 47 bp, Homo Sapiens
  allele 24: 99-10521-296 : polymorphic base C or T
tacaaaaaaataaataaataaaayaaataaaaaataaaaacagtttc

SEQ ID NO: 2344 - DNA, 47 bp, Homo Sapiens
  allele 24: 99-10522-395 : polymorphic base A or C
ttaataacaacaccatgtatymamtgcgttttatgtgtcaggaatta

SEQ ID NO: 2345 - DNA, 47 bp, Homo Sapiens
  allele 24: 99-10536-90 : polymorphic base C or A
tcctaaaatgtatagaatccaagmaatgtgtgaggttccatccacat

SEQ ID NO: 2346 - DNA, 47 bp, Homo Sapiens
  allele 24: 99-10539-208 : polymorphic base G or A
cagattctccctcacaatctctartatgaaccaaccctgccaacagc

SEQ ID NO: 2347 - DNA, 47 bp, Homo Sapiens
  allele 24: 99-10542-326 : polymorphic base C or T
caaataaatcattcattttctttytgtattttctttaggctcttctc

SEQ ID NO: 2348 - DNA, 47 bp, Homo Sapiens
  allele 24: 99-10543-278 : polymorphic base A or T
aaaatacagtctgtttcagtcttwtagactgttataaagccaaatga

SEQ ID NO: 2349 - DNA, 47 bp, Homo Sapiens
  allele 24: 99-1055-140 : polymorphic base C or T
ttttgctgtcaaccccatgccgtyatgtggatgagcaaagaacacag

SEQ ID NO: 2350 - DNA, 47 bp, Homo Sapiens
  allele 24: 99-10557-276 : polymorphic base T or C
cagacaacagatacgggattttayagcagcttctgggaaatttgctg

SEQ ID NO: 2351 - DNA, 47 bp, Homo Sapiens
  allele 24: 99-10567-233 : polymorphic base A or G
caaataccattacatcagagactrggtttccccatatgaattttggg

SEQ ID NO: 2352 - DNA, 47 bp, Homo Sapiens
  allele 24: 99-10570-107 : polymorphic base G or A
agccacctacagaatcaataacarcattttagttaggaccttgaggg

SEQ ID NO: 2353 - DNA, 47 bp, Homo Sapiens
  allele 24: 99-10573-375 : polymorphic base G or A
tgattctcctgcctcagcctcccragtagctgggattacaggcacac

SEQ ID NO: 2354 - DNA, 47 bp, Homo Sapiens
  allele 24: 99-10575-416 : polymorphic base T or C
ggtctcaaactcctgggctcaagygatcaacctacctcggtctctca

SEQ ID NO: 2355 - DNA, 47 bp, Homo Sapiens
  allele 24: 99-10576-351 : polymorphic base A or G
agaaaaccctaggaggcaagtttrattattttcccattttctagatg

SEQ ID NO: 2356 - DNA, 47 bp, Homo Sapiens
  allele 24: 99-10577-36 : polymorphic base T or C
aagattagaagtggagaccagacyctccagggacttcacctcacctt

SEQ ID NO: 2357 - DNA, 47 bp, Homo Sapiens
  allele 24: 99-10581-354 : polymorphic base G or C
cgaaaggggattcaacacctttcsgggtcgttctcacttcatttcca

SEQ ID NO: 2358 - DNA, 47 bp, Homo Sapiens
  allele 24: 99-10589-360 : polymorphic base A or C
cagagtcctcccaatcggggactmcccctgcccttgacatgtgggac

SEQ ID NO: 2359 - DNA, 47 bp, Homo Sapiens
  allele 24: 99-10601-463 : polymorphic base C or G
tctgcaggcaaggactttgtcttsttcattgttgcatcccaagcccc

SEQ ID NO: 2360 - DNA, 47 bp, Homo Sapiens
  allele 24: 99-10606-92 : polymorphic base G or A
cctatttaagattgcttgaaaacrtatgtgaagaatgaaataatcaa

SEQ ID NO: 2361 - DNA, 47 bp, Homo Sapiens
  allele 24: 99-10608-353 : polymorphic base C or T
cggcatttagataatttgcttgtytgggtgtgtgtggtctgtttaac

SEQ ID NO: 2362 - DNA, 47 bp, Homo Sapiens
  allele 24: 99-10613-277 : polymorphic base C or G
tcctccccatcattcccaggtctsgtcccccgaggagaggaaacagg

SEQ ID NO: 2363 - DNA, 47 bp, Homo Sapiens
  allele 24: 99-10618-404 : polymorphic base A or T
atgttttctgtttaataggagacwctaaactgacgtagaggagagaa

SEQ ID NO: 2364 - DNA, 47 bp, Homo Sapiens
  allele 24: 99-10626-196 : polymorphic base G or C
tggttacacctccacgttactttscaggtatgcccacatcattttat

SEQ ID NO: 2365 - DNA, 47 bp, Homo Sapiens
  allele 24: 99-10630-236 : polymorphic base G or A
tgattctgccatctggagcaacaraattcattcatttcctattcaat

SEQ ID NO: 2366 - DNA, 47 bp, Homo Sapiens
  allele 24: 99-10632-55 : polymorphic base A or T
aggaagcacatataaaactgtgawagtgaaattgccttctgggagat

SEQ ID NO: 2367 - DNA, 47 bp, Homo Sapiens
  allele 24: 99-10634-141 : polymorphic base G or A
tcctgcccaccttcaaccattctrggtctgaaaatctacattagtca

SEQ ID NO: 2368 - DNA, 47 bp, Homo Sapiens; identical to SEQ ID NO: 2314
  allele 24: 99-10643-161 : polymorphic base T or C

SEQ ID NO: 2369 - DNA, 47 bp, Homo Sapiens
  allele 24: 99-10659-208 : polymorphic base C or T
gcagacagattggggaggaatccyggaggcccacatccccaccagca

SEQ ID NO: 2370 - DNA, 47 bp, Homo Sapiens
  allele 24: 99-10661-153 : polymorphic base G or A
gtagagatgctcaaatggcccccrtggcctggctgccaggtgttggc

SEQ ID NO: 2371 - DNA, 47 bp, Homo Sapiens
  allele 24: 99-10662-397 : polymorphic base C or T
ctaatgtcagggttcctgatgacyggccactttgcttccacatgggg

SEQ ID NO: 2372 - DNA, 47 bp, Homo Sapiens
  allele 24: 99-10667-251 : polymorphic base G or C
atcaccgtcccagctcctcctccsaaagctctcaagttagctttaaa

SEQ ID NO: 2373 - DNA, 47 bp, Homo Sapiens
  allele 24: 99-10675-109 : polymorphic base A or G
attctcaaggcttttcaatatctrtaactacaccacctcagcaatcc

SEQ ID NO: 2374 - DNA, 47 bp, Homo Sapiens
  allele 24: 99-1068-309 : polymorphic base C or T
gattcaggatcagctgcctcctgytatgtgaccttgggtaaatcgct

SEQ ID NO: 2375 - DNA, 47 bp, Homo Sapiens
  allele 24: 99-10683-117 : polymorphic base A or G
ggtctgttctagagtctctgatgrctgcaaaggggtaagccacagtg

SEQ ID NO: 2376 - DNA, 47 bp, Homo Sapiens
  allele 24: 99-10689-419 : polymorphic base A or G
ggctggaaataggataatctggcrggttcctcacctgatagctaagg

SEQ ID NO: 2377 - DNA, 47 bp, Homo Sapiens
  allele 24: 99-10692-377 : polymorphic base G or A
cctaggattgatcagtttagtctrtactgaccttggaaactctgatt

SEQ ID NO: 2378 - DNA, 47 bp, Homo Sapiens
  allele 24: 99-10694-446 : polymorphic base C or T
ttaatacatacaataactataaaytgtataatagtagagggagtggt

SEQ ID NO: 2379 - DNA, 47 bp, Homo Sapiens
  allele 24: 99-10695-161 : polymorphic base C or T
aaaataagttggaggagagaaaaytgagtatattagggttctccaga

SEQ ID NO: 2380 - DNA, 47 bp, Homo Sapiens
  allele 24: 99-1070-342 : polymorphic base C or T
tggcccaactgtgtagatcataaygtgtaccccaaagaccagagaca

SEQ ID NO: 2381 - DNA, 47 bp, Homo Sapiens
  allele 24: 99-10702-261 : polymorphic base G or A
ggaaatagagaattttttagtgtrtcctaaggtgcatcttggtgttg

SEQ ID NO: 2382 - DNA, 47 bp, Homo Sapiens
  allele 24: 99-10706-228 : polymorphic base T or C
atgtagcttccccaacctccagcyaatcagcaccaaaatcctaagac

SEQ ID NO: 2383 - DNA, 47 bp, Homo Sapiens
  allele 24: 99-10708-28 : polymorphic base G or A
tcgttaaacacgtcgtgctccccrtgccacccaaccgggtgaaacct

SEQ ID NO: 2384 - DNA, 47 bp, Homo Sapiens
  allele 24: 99-10709-460 : polymorphic base G or A
tttatattccaaaatacatttgtrtatacatatgtatattattaata

SEQ ID NO: 2385 - DNA, 47 bp, Homo Sapiens
  allele 24: 99-10715-43 : polymorphic base A or G
caatgtccaatattttgctagagrtgatattgggtttaaagcacgat

SEQ ID NO: 2386 - DNA, 47 bp, Homo Sapiens
  allele 24: 99-10719-455 : polymorphic base C or T
cgttttcatgtattgaagttcaaytgctttgtgaaktcaaagwchyt

SEQ ID NO: 2387 - DNA, 47 bp, Homo Sapiens
  allele 24: 99-10720-63 : polymorphic base A or G
aattaaagaaacagggggctaacrtggtctttctgataaaaatcatg

SEQ ID NO: 2388 - DNA, 47 bp, Homo Sapiens
  allele 24: 99-10731-195 : polymorphic base C or T
gggcaacatggccagaccccgtcyttaaaaaggaaaaaagataaaaa

SEQ ID NO: 2389 - DNA, 47 bp, Homo Sapiens
  allele 24: 99-10735-238 : polymorphic base T or C
cattttttttccgcctctgagttygtggaggattggtgttaattctt

SEQ ID NO: 2390 - DNA, 47 bp, Homo Sapiens
  allele 24: 99-1074-127 : polymorphic base G or A
ttctaaaggcaaacaattatgagrgagagttgatttttccaaaacat

SEQ ID NO: 2391 - DNA, 47 bp, Homo Sapiens
  allele 24: 99-10741-421 : polymorphic base A or C
cctcattttacctcggattacatmtgcaaagaccctatttccaaata

SEQ ID NO: 2392 - DNA, 47 bp, Homo Sapiens
  allele 24: 99-10743-315 : polymorphic base T or A
tttttcatttaattaaaaaatttwatgtggtacaattataaacccat

SEQ ID NO: 2393 - DNA, 47 bp, Homo Sapiens
  allele 24: 99-1075-314 : polymorphic base G or A
atattacagatggggaaactgagraaagagacattcagtagtttgtc

SEQ ID NO: 2394 - DNA, 47 bp, Homo Sapiens
  allele 24: 99-10752-366 : polymorphic base A or G
tcttgtctgttgtcgtctagtgcrggagcttagtctaaaacaatggc

SEQ ID NO: 2395 - DNA, 47 bp, Homo Sapiens
  allele 24: 99-1076-116 : polymorphic base C or T
ttaggaaaggaatccttagctgtyagatgcttttaattccaacatga

SEQ ID NO: 2396 - DNA, 47 bp, Homo Sapiens
  allele 24: 99-10769-291 : polymorphic base A or C
aaaaaggagaagtcagctcaatgmtcacattgttcttagattcacca

SEQ ID NO: 2397 - DNA, 47 bp, Homo Sapiens
  allele 24: 99-10771-266 : polymorphic base A or C
gagcctaagtccacctctcccgtmcccagccctccactggggagctg

SEQ ID NO: 2398 - DNA, 47 bp, Homo Sapiens
  allele 24: 99-10775-331 : polymorphic base A or G
attatccccaaatttccttggaarggtaattgcaaaggatacttggc

SEQ ID NO: 2399 - DNA, 47 bp, Homo Sapiens
  allele 24: 99-10776-447 : polymorphic base T or A
tgtcatgtacaagaggttatgacwgaaaacaaaggaaaaaaagaaaa

SEQ ID NO: 2400 - DNA, 47 bp, Homo Sapiens
  allele 24: 99-1079-237 : polymorphic base C or G
ctaactgtgtttacctctggtgasagtgactggggaaagggcagaga

SEQ ID NO: 2401 - DNA, 47 bp, Homo Sapiens
  allele 24: 99-1081-159 : polymorphic base A or T
gtgtcttttttgacctccagtagwattttcatttcaattagttgcca

SEQ ID NO: 2402 - DNA, 47 bp, Homo Sapiens
  allele 24: 99-10816-272 : polymorphic base G or A
agagatgttctttctgtaattcaraaactgaagatgtgtcatctgct

SEQ ID NO: 2403 - DNA, 47 bp, Homo Sapiens
  allele 24: 99-1082-180 : polymorphic base T or A
ttcctcttgaagcacttaaaaaawtttttgcccagtggcttagaggc

SEQ ID NO: 2404 - DNA, 47 bp, Homo Sapiens
  allele 24: 99-10839-239 : polymorphic base C or T
ggattactatccatttccaaggayaactgctatgtgaattgggccac

SEQ ID NO: 2405 - DNA, 47 bp, Homo Sapiens
  allele 24: 99-10842-232 : polymorphic base A or G
agagtgccattctttcgtattacraaaagtgctttaatttgctgtat

SEQ ID NO: 2406 - DNA, 47 bp, Homo Sapiens
  allele 24: 99-10843-114 : polymorphic base A or G
ttttacagctttcttgaatgtctrtcttggtagaagacaatagagtt

SEQ ID NO: 2407 - DNA, 47 bp, Homo Sapiens
  allele 24: 99-10856-246 : polymorphic base C or G
ttcagagcagtcttcaatcttctsaaagaaatacaagtataatcctt

SEQ ID NO: 2408 - DNA, 47 bp, Homo Sapiens
  allele 24: 99-10861-96 : polymorphic base T or C
ttacagtgcaggaggaagtctaaygccttcccatgggcaagtcagat

SEQ ID NO: 2409 - DNA, 47 bp, Homo Sapiens
  allele 24: 99-10862-397 : polymorphic base T or C
ttcaagggcactttgaacttccaytggaaatgcaacaaaagttcaaa

SEQ ID NO: 2410 - DNA, 47 bp, Homo Sapiens
  allele 24: 99-10864-418 : polymorphic base C or G
agtgaaaaatacagcattgcgtascctcgctgcggcagaccagcagc

SEQ ID NO: 2411 - DNA, 47 bp, Homo Sapiens
  allele 24: 99-10870-234 : polymorphic base G or A
gggtctgccttaaggaatgccacrtcatttgaaaacattagcaatgt

SEQ ID NO: 2412 - DNA, 47 bp, Homo Sapiens
  allele 24: 99-10874-69 : polymorphic base G or A
taaatatcttacaacatatacacrtgtgtgtgtgtgtgtgtgtgtgt

SEQ ID NO: 2413 - DNA, 47 bp, Homo Sapiens
  allele 24: 99-10879-386 : polymorphic base A or G
actcactcatttgaccccaatgtraggctctttggttcaaatacagt

SEQ ID NO: 2414 - DNA, 47 bp, Homo Sapiens
  allele 24: 99-10887-214 : polymorphic base A or G
tgccctctgaagatttaaagcaarcctcgaaatgtttttacctattt

SEQ ID NO: 2415 - DNA, 47 bp, Homo Sapiens
  allele 24: 99-10890-201 : polymorphic base T or G
atgataaccgttgagttggggagkgtaatgtcaaagaataaaccagg

SEQ ID NO: 2416 - DNA, 47 bp, Homo Sapiens
  allele 24: 99-10894-35 : polymorphic base T or C
atagatatgtaaattctgtcttgycagtcagtgattttaattaactt

SEQ ID NO: 2417 - DNA, 47 bp, Homo Sapiens
  allele 24: 99-10898-209 : polymorphic base G or T
agcagaagccaggagaagcgaggktggcagggcagtccctggggact

SEQ ID NO: 2418 - DNA, 47 bp, Homo Sapiens
  allele 24: 99-10904-111 : polymorphic base C or T
tggggcagttaactggacatgcaygtgacatacccctaagaactatg

SEQ ID NO: 2419 - DNA, 47 bp, Homo Sapiens
  allele 24: 99-10905-85 : polymorphic base C or T
aatctgaaataatatatatcttayctgaaataagatatctgaatata

SEQ ID NO: 2420 - DNA, 47 bp, Homo Sapiens
  allele 24: 99-1091-446 : polymorphic base C or T
atatagagctggtccctctctctytatagcctctgtggagtcttgta

SEQ ID NO: 2421 - DNA, 47 bp, Homo Sapiens
  allele 24: 99-10927-388 : polymorphic base G or C
gacatgacaaaaggcaaaggaaastgatcctattggatgtggcaaga

SEQ ID NO: 2422 - DNA, 47 bp, Homo Sapiens
  allele 24: 99-10929-298 : polymorphic base T or A
aagaaaaaaaaatggccgtaatawgaagtgcccccggctctcatact

SEQ ID NO: 2423 - DNA, 47 bp, Homo Sapiens
  allele 24: 99-10930-95 : polymorphic base A or T
gtagggggcaagaggacaagcaawtaaaataaagaccatgcatgtct

SEQ ID NO: 2424 - DNA, 47 bp, Homo Sapiens
  allele 24: 99-10937-64 : polymorphic base T or C
ccatttacatttgaggttattatygataagcaaggatttactcctgc

SEQ ID NO: 2425 - DNA, 47 bp, Homo Sapiens
  allele 24: 99-10944-83 : polymorphic base G or A
agcacctttaaagactgaagcacratcttgggccagtttgtgaaggc

SEQ ID NO: 2426 - DNA, 47 bp, Homo Sapiens
  allele 24: 99-10951-434 : polymorphic base T or C
cagcttccccgccaaatggtctgytggcccacgcttgtcagagcact

SEQ ID NO: 2427 - DNA, 47 bp, Homo Sapiens
  allele 24: 99-10959-113 : polymorphic base C or T
gatggccaaatcctaaggtcttgyactggactgcatctccttaatct

SEQ ID NO: 2428 - DNA, 47 bp, Homo Sapiens
  allele 24: 99-10964-89 : polymorphic base T or C
aaaacttaatggcaaattagactytatcccagaataatgaaaggata

SEQ ID NO: 2429 - DNA, 47 bp, Homo Sapiens
  allele 24: 99-10965-174 : polymorphic base C or A
tatataaattattaagagttattmaaacctttcaaagacgttgtctc

SEQ ID NO: 2430 - DNA, 47 bp, Homo Sapiens
  allele 24: 99-10966-113 : polymorphic base G or A
tattaacaatatagttataaaatrtagttactgacaatatagtcatt

SEQ ID NO: 2431 - DNA, 47 bp, Homo Sapiens
  allele 24: 99-10974-193 : polymorphic base T or A
ttacttacagtttattgaattttwatctagttctgtatttctgcatg

SEQ ID NO: 2432 - DNA, 47 bp, Homo Sapiens
  allele 24: 99-10978-393 : polymorphic base T or A
aacctgaatctaaactgttgtttwaacccagctgtttcatgttgcca

SEQ ID NO: 2433 - DNA, 47 bp, Homo Sapiens
  allele 24: 99-10979-156 : polymorphic base T or A
tataatctgttttcaagaattcawaaaactatcatagaaatagaata

SEQ ID NO: 2434 - DNA, 47 bp, Homo Sapiens
  allele 24: 99-10988-242 : polymorphic base G or A
attttgcacctaaaaccttgcccratatagtatgtttaacaagtatt

SEQ ID NO: 2435 - DNA, 47 bp, Homo Sapiens
  allele 24: 99-10992-98 : polymorphic base G or A
attaaattttatcttgaaaatatrtggtatattattttaacattctg

SEQ ID NO: 2436 - DNA, 47 bp, Homo Sapiens
  allele 24: 99-11000-163 : polymorphic base A or G
ctgagagcactcagagatcagctrccactcttacccttccttcacat

SEQ ID NO: 2437 - DNA, 47 bp, Homo Sapiens
  allele 24: 99-11001-393 : polymorphic base C or T
aaaatatatgcagttctttatctyttaaaattgtcttaatatggatg

SEQ ID NO: 2438 - DNA, 47 bp, Homo Sapiens
  allele 24: 99-11003-361 : polymorphic base G or A
ggaattaacacaaaatagaactcrgttctattgtctctattcaaaca

SEQ ID NO: 2439 - DNA, 47 bp, Homo Sapiens
  allele 24: 99-11006-426 : polymorphic base C or T
aatttttaaggaaaaagaagttgytttgttaaatacatttttacacc

SEQ ID NO: 2440 - DNA, 47 bp, Homo Sapiens
  allele 24: 99-11007-68 : polymorphic base T or C
gacctaccaataagatgcaatcaygtgagatctgaaaggtggaagag

SEQ ID NO: 2441 - DNA, 47 bp, Homo Sapiens
  allele 24: 99-11014-194 : polymorphic base C or A
tggggattgggaccctcccatacmcttgtcaggcccctcgcagggaa

SEQ ID NO: 2442 - DNA, 47 bp, Homo Sapiens
  allele 24: 99-11034-317 : polymorphic base C or T
gatgctttaaaacaaaaactacayaatagacctatatagaaagacat

SEQ ID NO: 2443 - DNA, 47 bp, Homo Sapiens
  allele 24: 99-11035-299 : polymorphic base C or T
atgaaacataaagtcaggcataayactaatctagagtactcctgcct

SEQ ID NO: 2444 - DNA, 47 bp, Homo Sapiens
  allele 24: 99-11037-218 : polymorphic base C or A
tatctgctatcaataaaaaaatamaaaatacaattggtttaaattcc

SEQ ID NO: 2445 - DNA, 47 bp, Homo Sapiens
  allele 24: 99-1105-127 : polymorphic base A or C
aagctacaaaaatggcttcctggmagttccatgcttgtttccatgtg

SEQ ID NO: 2446 - DNA, 47 bp, Homo Sapiens
  allele 24: 99-11051-154 : polymorphic base A or T
tatatacttggctataaagactawtaaaaaaccacacacacacaaat

SEQ ID NO: 2447 - DNA, 47 bp, Homo Sapiens
  allele 24: 99-11063-111 : polymorphic base G or C
ccttaaataactgtgggaaggtasaactttatttccttcacataaat

SEQ ID NO: 2448 - DNA, 47 bp, Homo Sapiens
  allele 24: 99-11074-187 : polymorphic base A or G
cattttgtgtcagagcgcagatcrctgtaaataagggggtaatggcc

SEQ ID NO: 2449 - DNA, 47 bp, Homo Sapiens
  allele 24: 99-11075-311 : polymorphic base G or A
tcctcaccagatgccagtgccatrctcttggatttcccagtctccaa

SEQ ID NO: 2450 - DNA, 47 bp, Homo Sapiens
  allele 24: 99-11089-424 : polymorphic base C or A
ggcactgccgaccattaccggacmctctccctgccattctgtcatcc

SEQ ID NO: 2451 - DNA, 47 bp, Homo Sapiens
  allele 24: 99-11094-427 : polymorphic base G or A
caatgaacagcactggccaaastrtcgcagctttcaagtgcttttag

SEQ ID NO: 2452 - DNA, 47 bp, Homo Sapiens
  allele 24: 99-11099-179 : polymorphic base A or G
ttcctataaagggtaatataactrtcgttcttcgtttaccctaacaa

SEQ ID NO: 2453 - DNA, 47 bp, Homo Sapiens
  allele 24: 99-11103-88 : polymorphic base A or T
ccctgatgtcatagagatggtccwttttctctacatacaacctttct

SEQ ID NO: 2454 - DNA, 47 bp, Homo Sapiens
  allele 24: 99-11106-117 : polymorphic base C or T
atattatgaggactatctcaaacyaatgggcatgacatggtaatcca

SEQ ID NO: 2455 - DNA, 47 bp, Homo Sapiens
  allele 24: 99-11110-375 : polymorphic base C or T
ttgcttggtctctgtttagaataytagttagcaaggaataaatattt

SEQ ID NO: 2456 - DNA, 47 bp, Homo Sapiens
  allele 24: 99-11115-133 : polymorphic base A or G
taatttgtatagtaaatgcaattrggaaagggatattgcctggaaaa

SEQ ID NO: 2457 - DNA, 47 bp, Homo Sapiens
  allele 24: 99-11119-132 : polymorphic base T or C
cgaatacaaagagacaggagccayttgatgagcatagcaaaacaagc

SEQ ID NO: 2458 - DNA, 47 bp, Homo Sapiens
  allele 24: 99-11128-162 : polymorphic base A or G
aacttgggggcatgaaaaatttartgcatgtgggaagacaaggaagg

SEQ ID NO: 2459 - DNA, 47 bp, Homo Sapiens
  allele 24: 99-11136-374 : polymorphic base G or A
ttgtgagactttagttagtgcccrgtaaatctataaatttataagga

SEQ ID NO: 2460 - DNA, 47 bp, Homo Sapiens
  allele 24: 99-11142-139 : polymorphic base T or C
ctaggattttccccaccttgagayacccaggatcttcattactgcct

SEQ ID NO: 2461 - DNA, 47 bp, Homo Sapiens
  allele 24: 99-11143-443 : polymorphic base A or C
cagttgatattggcacctgctttmatcccatagcccatattttacaa

SEQ ID NO: 2462 - DNA, 47 bp, Homo Sapiens
  allele 24: 99-11144-137 : polymorphic base G or A
aagagactaatttcatatttgctrtaattaaccactaacacagatgt

SEQ ID NO: 2463 - DNA, 47 bp, Homo Sapiens
  allele 24: 99-11148-369 : polymorphic base A or C
cacgaaggcattaaaaccaacgamcttctcaaaacttaagctgtcac

SEQ ID NO: 2464 - DNA, 47 bp, Homo Sapiens
  allele 24: 99-11158-255 : polymorphic base C or T
tgccacacccctcccacaaagccyggctctggcccgggacacaggga

SEQ ID NO: 2465 - DNA, 47 bp, Homo Sapiens
  allele 24: 99-11163-293 : polymorphic base C or G
cggggagggatggaggggaggggscctaggcttctggacgtctgtgt

SEQ ID NO: 2466 - DNA, 47 bp, Homo Sapiens
  allele 24: 99-11164-298 : polymorphic base C or T
agggacagcaatgaacaaagttaygttaaaataaagtttttgtatag

SEQ ID NO: 2467 - DNA, 47 bp, Homo Sapiens
  allele 24: 99-11168-197 : polymorphic base G or A
tgctaagaaaaccacaataattcrattatgtaaacattgctcaattg

SEQ ID NO: 2468 - DNA, 47 bp, Homo Sapiens
  allele 24: 99-11175-348 : polymorphic base A or C
atcagcctttaaaaagtcaccaamaaatagcaaaatgttttaagaaa

SEQ ID NO: 2469 - DNA, 47 bp, Homo Sapiens
  allele 24: 99-11179-239 : polymorphic base C or T
acctatatttgtcttacaaaaagytatatgttttaattttataatgc

SEQ ID NO: 2470 - DNA, 47 bp, Homo Sapiens
  allele 24: 99-11180-148 : polymorphic base A or G
aatttaagtagacatttaaaaatrtatagctgtttgtttgtgactgt

SEQ ID NO: 2471 - DNA, 47 bp, Homo Sapiens
  allele 24: 99-11183-166 : polymorphic base G or A
ctttttctgtagagatgctaaggrcacttataagtctcagtctttga

SEQ ID NO: 2472 - DNA, 47 bp, Homo Sapiens
  allele 24: 99-11191-86 : polymorphic base A or G
tgcccttaagaaatatacactgartaaataagaataaaagagaagca

SEQ ID NO: 2473 - DNA, 47 bp, Homo Sapiens
  allele 24: 99-11210-235 : polymorphic base G or A
  misc_feature 1: n=a, g, c or t
ntgcagatcccagcttcctgtaarcagcctcagatcaggccaaacct

SEQ ID NO: 2474 - DNA, 47 bp, Homo Sapiens
  allele 24: 99-11214-188 : polymorphic base T or G
atctgcagaacagagtgcatacakaaagagctcagaagtgaaagatg

SEQ ID NO: 2475 - DNA, 47 bp, Homo Sapiens
  allele 24: 99-11218-174 : polymorphic base G or A
gttcttctcccagcaccattagargcacacgaggaagcaaatgaaga

SEQ ID NO: 2476 - DNA, 47 bp, Homo Sapiens
  allele 24: 99-11236-63 : polymorphic base C or T
cacagaaatttaaaaagtcttttytgtgggtgttttgaggtttttaa

SEQ ID NO: 2477 - DNA, 47 bp, Homo Sapiens
  allele 24: 99-11247-86 : polymorphic base C or G
cagctttcagtgggagctataaasgtcagtgttgccttagcctcaga

SEQ ID NO: 2478 - DNA, 47 bp, Homo Sapiens
  allele 24: 99-11248-404 : polymorphic base A or G
agacagtgtagtggttctatcacrtatttcactgcaagggaacccaa

SEQ ID NO: 2479 - DNA, 47 bp, Homo Sapiens
  allele 24: 99-11252-263 : polymorphic base T or A
ggggaaaaagctactgcagccggwggccaggactcggccagagactc

SEQ ID NO: 2480 - DNA, 47 bp, Homo Sapiens
  allele 24: 99-11255-375 : polymorphic base G or A
aggctgttggagagagagagaacrcggaaggctccgggtggatttgt

SEQ ID NO: 2481 - DNA, 47 bp, Homo Sapiens
  allele 24: 99-11260-422 : polymorphic base C or T
gccttcactttccacctgctgtgygctttgaacaagctccttaacct

SEQ ID NO: 2482 - DNA, 47 bp, Homo Sapiens
  allele 24: 99-11261-255 : polymorphic base G or A
ggaacagcctgtgcaaaggccccraggtaggaacaagatgcaggggc

SEQ ID NO: 2483 - DNA, 47 bp, Homo Sapiens
  allele 24: 99-11293-125 : polymorphic base G or A
gatatagttattattactgtgatrgttgtcatcatcttccccatctt

SEQ ID NO: 2484 - DNA, 47 bp, Homo Sapiens
  allele 24: 99-11313-95 : polymorphic base G or A
atcagcaccattttagtattttaraattccaatgaggttcccaacgg

SEQ ID NO: 2485 - DNA, 47 bp, Homo Sapiens
  allele 24: 99-11320-29 : polymorphic base C or T
ttatgggtcttttttgttcttggygaagttttccattgtggaagcaa

SEQ ID NO: 2486 - DNA, 47 bp, Homo Sapiens
  allele 24: 99-11326-356 : polymorphic base A or G
ttaaagttctgtttataatcctaraagattcctgccttagggatatg

SEQ ID NO: 2487 - DNA, 47 bp, Homo Sapiens
  allele 24: 99-11340-89 : polymorphic base C or T
ctgtagcccagtcaggggcaggcyggtcggcagctgggggttgaggc

SEQ ID NO: 2488 - DNA, 47 bp, Homo Sapiens
  allele 24: 99-11346-222 : polymorphic base T or C
ctatataaatacacacacacacayatatagtagcctaatatttaaaa

SEQ ID NO: 2489 - DNA, 47 bp, Homo Sapiens
  allele 24: 99-11350-116 : polymorphic base A or G
tcagtacctagatatattggcttrtccaaggtgcatagccacttctt

SEQ ID NO: 2490 - DNA, 47 bp, Homo Sapiens
  allele 24: 99-11356-187 : polymorphic base A or T
aagttactgccccttttcatagcwacgaccaaagttaccacccctat

SEQ ID NO: 2491 - DNA, 47 bp, Homo Sapiens
  allele 24: 99-11362-334 : polymorphic base C or T
aaaataaatgagatatctatcatytaaccataactttgaatctgtga

SEQ ID NO: 2492 - DNA, 47 bp, Homo Sapiens
  allele 24: 99-11369-112 : polymorphic base C or G
ccctacttggtggctggatctctstgattctattagagacaattgtc

SEQ ID NO: 2493 - DNA, 47 bp, Homo Sapiens
  allele 24: 99-11372-162 : polymorphic base C or A
aactttgaaacacttcaggagggmcagccctttggatcttagcctgc

SEQ ID NO: 2494 - DNA, 47 bp, Homo Sapiens
  allele 24: 99-11377-384 : polymorphic base A or G
tctagccacacatacccacgtgtrctcctgagttcagtgtgcccacc

SEQ ID NO: 2495 - DNA, 47 bp, Homo Sapiens
  allele 24: 99-11381-256 : polymorphic base C or G
gcaccctagcaatgatggagctgsaaagccaggtagggcctaaacac

SEQ ID NO: 2496 - DNA, 47 bp, Homo Sapiens
  allele 24: 99-11385-245 : polymorphic base C or T
gctctggaagagtcaaagcggtcycctgaagcaatcctggcatggtc

SEQ ID NO: 2497 - DNA, 47 bp, Homo Sapiens
  allele 24: 99-11413-239 : polymorphic base A or G
gtagccttctaactggccctatcrcttccacccgcccttgccccctc

SEQ ID NO: 2498 - DNA, 47 bp, Homo Sapiens
  allele 24: 99-1143-340 : polymorphic base G or A
ggccagggtccctttgagataaartcttgcaaaatttcatgtgcatg

SEQ ID NO: 2499 - DNA, 47 bp, Homo Sapiens
  allele 24: 99-11430-162 : polymorphic base C or A
ccaccacaatgctgtctattaaamccctgccctagcagctatgccct

SEQ ID NO: 2500 - DNA, 47 bp, Homo Sapiens
  allele 24: 99-11431-333 : polymorphic base A or G
atactttattatgtctatcgtgcrtccaaggcttaaatgcattacac

SEQ ID NO: 2501 - DNA, 47 bp, Homo Sapiens
  allele 24: 99-11449-297 : polymorphic base A or G
tccaaatgcaggaatgttcacagrgcaaatacttgcagcacacatgg

SEQ ID NO: 2502 - DNA, 47 bp, Homo Sapiens
  allele 24: 99-11464-236 : polymorphic base C or G
gtgagtattaatgagtggcgttasaaggcatggggcacctagtgagg

SEQ ID NO: 2503 - DNA, 47 bp, Homo Sapiens
  allele 24: 99-11466-107 : polymorphic base T or C
gaacacggtattcgggaaacttcygcaaggacaggaagaaatcaaac

SEQ ID NO: 2504 - DNA, 47 bp, Homo Sapiens
  allele 24: 99-11485-396 : polymorphic base T or A
tagcctgaatacactcctcaaatwgaattcccagggcaggcaaacaa

SEQ ID NO: 2505 - DNA, 47 bp, Homo Sapiens
  allele 24: 99-11492-360 : polymorphic base A or T
cccatcgttacagcatcataaagwttgcttccatttgctgatacaga

SEQ ID NO: 2506 - DNA, 47 bp, Homo Sapiens
  allele 24: 99-11499-45 : polymorphic base G or A
ggcctgtcaatcatatcatgttcrtctttttatggctctgctgaaaa

SEQ ID NO: 2507 - DNA, 47 bp, Homo Sapiens
  allele 24: 99-11505-92 : polymorphic base A or G
gcctatcctggggatacaaggtargttagtcagtggacaaatccttc

SEQ ID NO: 2508 - DNA, 47 bp, Homo Sapiens
  allele 24: 99-11506-224 : polymorphic base G or C
cccaatttttttgagctcttggtsaatgtatttgacaagccagccct

SEQ ID NO: 2509 - DNA, 47 bp, Homo Sapiens
  allele 24: 99-11520-170 : polymorphic base A or G
tacccactggagtgtttcactggrgagagttgtgggagttccgtttt

SEQ ID NO: 2510 - DNA, 47 bp, Homo Sapiens
  allele 24: 99-11521-146 : polymorphic base G or T
cccagctgcatccagaccatttakaagaggacctctgaggatggacg

SEQ ID NO: 2511 - DNA, 47 bp, Homo Sapiens
  allele 24: 99-11522-313 : polymorphic base C or T
ttgatcttgagcaaagcaaatgayttggtttttttttctttaaatga

SEQ ID NO: 2512 - DNA, 47 bp, Homo Sapiens
  allele 24: 99-11528-137 : polymorphic base A or T
gaaatgtagtgtagttgggatggwctgagtgaggtggagtgaaggct

SEQ ID NO: 2513 - DNA, 47 bp, Homo Sapiens
  allele 24: 99-11530-388 : polymorphic base G or A
cattttggtaacagtgaaatccarcactaattgctggaaggaccgtt

SEQ ID NO: 2514 - DNA, 47 bp, Homo Sapiens
  allele 24: 99-11533-375 : polymorphic base C or G
gctcctacaaaacttcgtaaatgsgcagagagtctctggatggtcgt

SEQ ID NO: 2515 - DNA, 47 bp, Homo Sapiens
  allele 24: 99-11535-193 : polymorphic base G or T
agagacacagggcctctcgctggkagccgttgggaaccgtcctccga

SEQ ID NO: 2516 - DNA, 47 bp, Homo Sapiens
  allele 24: 99-11543-415 : polymorphic base A or T
ttgagacatggagtactctcaggwctttgcccagtgaaagtttttgg

SEQ ID NO: 2517 - DNA, 47 bp, Homo Sapiens
  allele 24: 99-11545-180 : polymorphic base T or C
agatggggcaccgacattgcccaytccagcttgctaacttctacact

SEQ ID NO: 2518 - DNA, 47 bp, Homo Sapiens
  allele 24: 99-11555-397 : polymorphic base C or T
tctgaggccacgctcaacgggccyggcagaggctcccgtcttcctcc

SEQ ID NO: 2519 - DNA, 47 bp, Homo Sapiens
  allele 24: 99-11559-81 : polymorphic base C or A
ttgaaccagccacctccccactamcctttggagaggttttgggacca

SEQ ID NO: 2520 - DNA, 47 bp, Homo Sapiens
  allele 24: 99-11563-183 : polymorphic base A or G
ctctcaagaagcagattccgcacrtggctgtggatggaaacatggac

SEQ ID NO: 2521 - DNA, 47 bp, Homo Sapiens
  allele 24: 99-11565-305 : polymorphic base C or A
gagctgcttgaccttggacaaatmacctttaatctctgagtcttttg

SEQ ID NO: 2522 - DNA, 47 bp, Homo Sapiens
  allele 24: 99-11566-385 : polymorphic base G or A
gagcaccagcaccccagtttgctrtccatcggcccagacacaccctg

SEQ ID NO: 2523 - DNA, 47 bp, Homo Sapiens
  allele 24: 99-11580-97 : polymorphic base A or G
ccgtcccgtccagcaacagaggcrcctggggccggggaggtgagcgg

SEQ ID NO: 2524 - DNA, 47 bp, Homo Sapiens
  allele 24: 99-11584-69 : polymorphic base A or G
ttcctccctgaagaccttgaacgrgtttcctaaactctctcagtctc

SEQ ID NO: 2525 - DNA, 47 bp, Homo Sapiens
  allele 24: 99-11587-202 : polymorphic base A or G
aacgcccagcatggagtatggggratgcttaagagaggctggcagct

SEQ ID NO: 2526 - DNA, 47 bp, Homo Sapiens
  allele 24: 99-11592-297 : polymorphic base C or A
taataaattctcccctgcaggacmtggttttaattaattattgggtt

SEQ ID NO: 2527 - DNA, 47 bp, Homo Sapiens
  allele 24: 99-11600-48 : polymorphic base A or G
cttggatgctattcccacacaggrgatggtatggttggcagaatgat

SEQ ID NO: 2528 - DNA, 47 bp, Homo Sapiens
  allele 24: 99-11601-441 : polymorphic base C or T
tgtgggtgctcaataaatgttgaytgactgagtaaacaatgaatgta

SEQ ID NO: 2529 - DNA, 47 bp, Homo Sapiens
  allele 24: 99-11602-93 : polymorphic base G or A
cttaggttctaattcatctgtgaraatgggcaagtttaatttctcta

SEQ ID NO: 2530 - DNA, 47 bp, Homo Sapiens
  allele 24: 99-11604-396 : polymorphic base T or C
caatatctttagcagagcagagaygaaaatgtgctagcaatttttac

SEQ ID NO: 2531 - DNA, 47 bp, Homo Sapiens
  allele 24: 99-11611-259 : polymorphic base A or G
gtcagccagaaaccccttcacccrtcctcatctggactatatcctgt

SEQ ID NO: 2532 - DNA, 47 bp, Homo Sapiens
  allele 24: 99-11613-315 : polymorphic base T or C
atttcagacttctaatgtccaaaytgcccactcaacatctccactga

SEQ ID NO: 2533 - DNA, 47 bp, Homo Sapiens
  allele 24: 99-11620-149 : polymorphic base A or C
tacagaacctctaacagggatcgmagatgtgcagtaacaattatagt

SEQ ID NO: 2534 - DNA, 47 bp, Homo Sapiens
  allele 24: 99-11635-363 : polymorphic base C or T
cttcttagagaaatggatgacttyagggctggaacaaggaaagtata

SEQ ID NO: 2535 - DNA, 47 bp, Homo Sapiens
  allele 24: 99-11643-378 : polymorphic base C or T
tactaatgtgtctaatgttgtccyagccctgtgagagatacatagga

SEQ ID NO: 2536 - DNA, 47 bp, Homo Sapiens
  allele 24: 99-11645-157 : polymorphic base C or T
cccactgggcaaggccttgcagaycataccagcaattttgggacttt

SEQ ID NO: 2537 - DNA, 47 bp, Homo Sapiens
  allele 24: 99-11658-275 : polymorphic base G or A
caaggttaagattttcaaaatctrtgtatcaactcccttgattttac

SEQ ID NO: 2538 - DNA, 47 bp, Homo Sapiens
  allele 24: 99-11668-308 : polymorphic base T or C
gatagccatctgtttcagaaaacyggcattctggctgttgcctaaat

SEQ ID NO: 2539 - DNA, 47 bp, Homo Sapiens
  allele 24: 99-11669-394 : polymorphic base C or T
ggacctgactcctttacagaatgyctgcttttggaccaaaaccaggg

SEQ ID NO: 2540 - DNA, 47 bp, Homo Sapiens
  allele 24: 99-11670-486 : polymorphic base G or T
tttaagagaatgtcatctgctctkttaacagcctccctctccaaaca

SEQ ID NO: 2541 - DNA, 47 bp, Homo Sapiens
  allele 24: 99-11685-200 : polymorphic base T or C
tacaggccgggtgcagtggctcaygcctgtaatcccaggactttggg

SEQ ID NO: 2542 - DNA, 47 bp, Homo Sapiens
  allele 24: 99-11697-345 : polymorphic base C or T
ctttcaaccaagtaactcttaaayggaaataaaattagccttttgcc

SEQ ID NO: 2543 - DNA, 47 bp, Homo Sapiens
  allele 24: 99-11700-326 : polymorphic base T or C
gtggtaatttattacagcaaccaygggaaactaatacagtgccccac

SEQ ID NO: 2544 - DNA, 46 bp, Homo Sapiens
  allele 23: 99-11704-23 : polymorphic base T or C
accaccaaatctgaccacccatygtacattcacttatcaatatgaa

SEQ ID NO: 2545 - DNA, 47 bp, Homo Sapiens
  allele 24: 99-11705-302 : polymorphic base G or T
taagacatctaaaggcgaagaaakctgcccgagcttgtacagtttca

SEQ ID NO: 2546 - DNA, 47 bp, Homo Sapiens
  allele 24: 99-11723-211 : polymorphic base A or T
tgtctatatgctcaccagctttawttttctttcgagaactttccatt

SEQ ID NO: 2547 - DNA, 47 bp, Homo Sapiens
  allele 24: 99-11743-233 : polymorphic base C or T
ccctgggggatgtggggttcaagygaaaacactggcttttccttctt

SEQ ID NO: 2548 - DNA, 47 bp, Homo Sapiens
  allele 24: 99-11745-256 : polymorphic base A or G
gggcatcctgacgagcatagtgcrgtgaggtggggtgatggtatcct

SEQ ID NO: 2549 - DNA, 47 bp, Homo Sapiens
  allele 24: 99-11746-238 : polymorphic base A or G
cgaactcaccagagcacaaccagrtcttgggtatctctgccctcatt

SEQ ID NO: 2550 - DNA, 47 bp, Homo Sapiens
  allele 24: 99-11780-292 : polymorphic base G or T
tggagaaggtgttaccgactctckgcatccgagtcagcaactaactg

SEQ ID NO: 2551 - DNA, 47 bp, Homo Sapiens
  allele 24: 99-11785-167 : polymorphic base A or G
agcatacccctagggacctaggarcagggagggagagaggcagccct

SEQ ID NO: 2552 - DNA, 47 bp, Homo Sapiens
  allele 24: 99-11786-98 : polymorphic base G or T
ctccaccctgcttctgctctaggkcctggggacaggaggaggcagtg

SEQ ID NO: 2553 - DNA, 47 bp, Homo Sapiens
  allele 24: 99-11787-281 : polymorphic base G or A
cctgaacggtcttgcccactcccrccccaccagccaaggccaaggcc

SEQ ID NO: 2554 - DNA, 47 bp, Homo Sapiens
  allele 24: 99-11788-69 : polymorphic base G or A
cccctggacccagacagcctagcrtcaaatcctggcactaccttcca

SEQ ID NO: 2555 - DNA, 47 bp, Homo Sapiens
  allele 24: 99-11789-348 : polymorphic base A or C
gccccgactacctctgtgcactgmtcaccagcacccttataattcct

SEQ ID NO: 2556 - DNA, 47 bp, Homo Sapiens
  allele 24: 99-11797-147 : polymorphic base A or G
aaaccattccaaacagccttataratgctagaatgagggtaagcaca

SEQ ID NO: 2557 - DNA, 47 bp, Homo Sapiens
  allele 24: 99-11810-289 : polymorphic base A or C
ggaggagaaaagccatataaatamgttaaacatgttaactgagcctt

SEQ ID NO: 2558 - DNA, 47 bp, Homo Sapiens
  allele 24: 99-11811-158 : polymorphic base A or G
tctcagtgagagcccatttgtagraaatctacctgttggtgcttaca

SEQ ID NO: 2559 - DNA, 47 bp, Homo Sapiens
  allele 24: 99-1182-310 : polymorphic base G or A
aacagcacccttcctttcctttgrataactgtgcctactgcatttcc

SEQ ID NO: 2560 - DNA, 47 bp, Homo Sapiens
  allele 24: 99-11823-118 : polymorphic base G or A
aatgtttctgcattttccttatcrtttcattaaacaacttctcagtt

SEQ ID NO: 2561 - DNA, 47 bp, Homo Sapiens
  allele 24: 99-11824-90 : polymorphic base T or A
cagaggtctgcagagtaaattttwaaaaaaagcttaactgtatgttt

SEQ ID NO: 2562 - DNA, 47 bp, Homo Sapiens
  allele 24: 99-1183-182 : polymorphic base G or A
ccaaacgtttggtagaattttccrgtaaaatcatttaagccaggaga

SEQ ID NO: 2563 - DNA, 47 bp, Homo Sapiens
  allele 24: 99-11830-334 : polymorphic base C or G
aagaggaagtcatgctttctttgsgggggtggcagagtggcaggaac

SEQ ID NO: 2564 - DNA, 47 bp, Homo Sapiens
  allele 24: 99-11831-321 : polymorphic base C or T
tcaggtgcagcaggcccagtggcygtggggcagagcctgaggaccag

SEQ ID NO: 2565 - DNA, 47 bp, Homo Sapiens
  allele 24: 99-11839-223 : polymorphic base C or T
agcagctcctggggctatagactyatttgataccagcaagaaagagc

SEQ ID NO: 2566 - DNA, 47 bp, Homo Sapiens
  allele 24: 99-11842-197 : polymorphic base T or C
tgttctgtgtccgcaatgcccagyggggtagctgctagccacatgtg

SEQ ID NO: 2567 - DNA, 47 bp, Homo Sapiens
  allele 24: 99-1185-317 : polymorphic base T or G
tcgattttgcttttatgcctgaakgatatttctcctagttatagaat

SEQ ID NO: 2568 - DNA, 47 bp, Homo Sapiens
  allele 24: 99-11851-45 : polymorphic base C or G
ctgccctatctatcctgaagagasagttttatcctccacctgccaag

SEQ ID NO: 2569 - DNA, 47 bp, Homo Sapiens
  allele 24: 99-11857-368 : polymorphic base G or A
cacagcatgggctggcgacacccrcagccccggggcgactgggagga

SEQ ID NO: 2570 - DNA, 47 bp, Homo Sapiens
  allele 24: 99-1186-249 : polymorphic base G or A
tatcctcctgttctggaaattttrtttgattcttcctatatattctt

SEQ ID NO: 2571 - DNA, 47 bp, Homo Sapiens
  allele 24: 99-11861-254 : polymorphic base C or T
gcgctaatggaagggaagcaaccycagacacatgggacaccagggga

SEQ ID NO: 2572 - DNA, 47 bp, Homo Sapiens
  allele 24: 99-11877-237 : polymorphic base T or C
tgggtgagggtgggaacccaggcyacagctggatgaagagaatggag

SEQ ID NO: 2573 - DNA, 47 bp, Homo Sapiens
  allele 24: 99-11880-90 : polymorphic base G or C
aacaagtttaggggcctggctctscccttcagttgcctgctagacct

SEQ ID NO: 2574 - DNA, 47 bp, Homo Sapiens
  allele 24: 99-11882-120 : polymorphic base A or G
tacgcctcagctttgtgtgtacgrtgtgaggcaggctgagggcgcac

SEQ ID NO: 2575 - DNA, 45 bp, Homo Sapiens
  allele 24: 99-11894-470 : polymorphic base G or A
aaagtgccaccaaaatatttaaartggataatggctggcatttgt

SEQ ID NO: 2576 - DNA, 47 bp, Homo Sapiens
  allele 24: 99-11917-129 : polymorphic base A or G
ccaggctggagcgtagtggtgcartcgtagcttgctatattctccaa

SEQ ID NO: 2577 - DNA, 47 bp, Homo Sapiens
  allele 24: 99-11922-206 : polymorphic base G or A
ttttactcctgctccttagttccrtctggtcttactgtttttctttg

SEQ ID NO: 2578 - DNA, 47 bp, Homo Sapiens
  allele 24: 99-11930-395 : polymorphic base C or T
catcatagtggtgcttcctgcccygtccccagtgtcagacaaacctt

SEQ ID NO: 2579 - DNA, 47 bp, Homo Sapiens
  allele 24: 99-11966-288 : polymorphic base A or G
tgcctgttccaagaggccccgagrccctccctcccatccagctctca

SEQ ID NO: 2580 - DNA, 47 bp, Homo Sapiens
  allele 24: 99-11989-233 : polymorphic base C or A
tgaccaattcagctgtttctgtamgtcatttccgttttctgtatgtc

SEQ ID NO: 2581 - DNA, 47 bp, Homo Sapiens
  allele 24: 99-11993-468 : polymorphic base C or T
tggtaatttaaaaataagcaataygctatttttagtatcttaacttc

SEQ ID NO: 2582 - DNA, 47 bp, Homo Sapiens
  allele 24: 99-12000-355 : polymorphic base T or C
gattctcaaattttgctgcacatyaaaatctcctggagatctttaaa

SEQ ID NO: 2583 - DNA, 47 bp, Homo Sapiens
  allele 24: 99-12005-282 : polymorphic base C or T
ctcaataccttttaaatgaaaaayagacattgtagagagtaggaggg

SEQ ID NO: 2584 - DNA, 47 bp, Homo Sapiens
  allele 24: 99-12017-203 : polymorphic base G or T
aaccaattttaataagtggaaaakaattcagattcctctgacaatag

SEQ ID NO: 2585 - DNA, 47 bp, Homo Sapiens
  allele 24: 99-1202-340 : polymorphic base C or T
ctctctccaaaaaaagaaaatggycaggtgttgtcagaaggttagga

SEQ ID NO: 2586 - DNA, 47 bp, Homo Sapiens
  allele 24: 99-12028-121 : polymorphic base T or C
tatgggcatgaaatagttgaattyccaggctcttaaaataggacagg

SEQ ID NO: 2587 - DNA, 47 bp, Homo Sapiens
  allele 24: 99-1203-272 : polymorphic base A or G
ccgggttctcagcaagccgagctrgtgcgggatcctgcatggggaca

SEQ ID NO: 2588 - DNA, 47 bp, Homo Sapiens
  allele 24: 99-12038-420 : polymorphic base C or T
caatcttaaattttgtgggaacaygataaattatgctttaaatcatt

SEQ ID NO: 2589 - DNA, 47 bp, Homo Sapiens
  allele 24: 99-12039-389 : polymorphic base C or T
tatacactatgctacctaatagtycttattaaaatctataattactt

SEQ ID NO: 2590 - DNA, 47 bp, Homo Sapiens
  allele 24: 99-12048-300 : polymorphic base A or G
ctaatgtatacattgaggctaacrtagtgccttgtacaaacataaca

SEQ ID NO: 2591 - DNA, 47 bp, Homo Sapiens
  allele 24: 99-12049-245 : polymorphic base A or G
agcatcatttcactgtcagatacragagcctggtaaaactcctataa

SEQ ID NO: 2592 - DNA, 47 bp, Homo Sapiens
  allele 24: 99-12050-459 : polymorphic base A or G
tattcattgaactttatacttagrttgtttgcacattgtttgaacat

SEQ ID NO: 2593 - DNA, 47 bp, Homo Sapiens
  allele 24: 99-12061-211 : polymorphic base A or G
tgtttataaaccaaggtgcatctrtggaactagtactttaatacttg

SEQ ID NO: 2594 - DNA, 47 bp, Homo Sapiens
  allele 24: 99-12062-94 : polymorphic base G or A
aattggagaaaccaaccaaacatrtacaaaaagaaaattaaatcttt

SEQ ID NO: 2595 - DNA, 47 bp, Homo Sapiens
  allele 24: 99-12068-348 : polymorphic base T or C
ttactctacccccacccccataayacccaatctttcttacatttgga

SEQ ID NO: 2596 - DNA, 47 bp, Homo Sapiens
  allele 24: 99-12087-45 : polymorphic base C or T
acagagtcatgcctcggtttcttyacataacaaatgtaaataagaat

SEQ ID NO: 2597 - DNA, 47 bp, Homo Sapiens
  allele 24: 99-1211-59 : polymorphic base C or T
ttccacctggggaggcaagtggayggggtcctggagatggtgtccag

SEQ ID NO: 2598 - DNA, 47 bp, Homo Sapiens
  allele 24: 99-12130-72 : polymorphic base G or A
cagaacacatctagtagaagacargtaatatgaggaaagaggttgag

SEQ ID NO: 2599 - DNA, 47 bp, Homo Sapiens
  allele 24: 99-12133-294 : polymorphic base T or C
tttaacctggggaagagaatatgyggctggctcattccttgctctgt

SEQ ID NO: 2600 - DNA, 47 bp, Homo Sapiens
  allele 24: 99-12135-288 : polymorphic base C or A
aaacattgaggattcaaaatcaamaaaagaccctcgggaactagaaa

SEQ ID NO: 2601 - DNA, 47 bp, Homo Sapiens
  allele 24: 99-12152-332 : polymorphic base A or G
tttttttctaaagtcaggtaactrcagtcgaaccacaaagcttctga

SEQ ID NO: 2602 - DNA, 47 bp, Homo Sapiens
  allele 24: 99-12158-148 : polymorphic base A or G
tgcctttccttgagagtcagccarttctcttaaggggccattcaagg

SEQ ID NO: 2603 - DNA, 47 bp, Homo Sapiens
  allele 24: 99-12168-256 : polymorphic base C or T
actgaatatccatccatatgtaaycacccaatggcttctccatgtct

SEQ ID NO: 2604 - DNA, 47 bp, Homo Sapiens
  allele 24: 99-12171-93 : polymorphic base G or A
cttgagcagagaggtgcactaatrccacataaagatgattatactga

SEQ ID NO: 2605 - DNA, 47 bp, Homo Sapiens
  allele 24: 99-12178-423 : polymorphic base C or T
tatcgtgtgtgtgtacacgtgcaygtgtgtgtgtaaaagagggctcc

SEQ ID NO: 2606 - DNA, 47 bp, Homo Sapiens
  allele 24: 99-12181-226 : polymorphic base T or C
cttgtgtaaagcctttttcacttytcatcatctctacttctccatcc

SEQ ID NO: 2607 - DNA, 47 bp, Homo Sapiens
  allele 24: 99-12186-229 : polymorphic base C or T
ttcatgtgtaaacaccaactggcygtgctcatggtaagactggaaac

SEQ ID NO: 2608 - DNA, 47 bp, Homo Sapiens
  allele 24: 99-12198-289 : polymorphic base A or G
cattacaggccctgaaatgccctracaactgttttggattaggtggg

SEQ ID NO: 2609 - DNA, 47 bp, Homo Sapiens
  allele 24: 99-12199-246 : polymorphic base T or C
attgcccctcaacaatagcacccyatatcaccaaagcatctgtttac

SEQ ID NO: 2610 - DNA, 47 bp, Homo Sapiens
  allele 24: 99-12203-356 : polymorphic base C or G
ctaatttgggggtttctcggtgtstgacgcaagcctccattgtccct

SEQ ID NO: 2611 - DNA, 47 bp, Homo Sapiens
  allele 24: 99-12224-368 : polymorphic base A or G
catctatgtgttaaaaaagcaaarcaaacaaaaactttttttttgct

SEQ ID NO: 2612 - DNA, 47 bp, Homo Sapiens
  allele 24: 99-12228-184 : polymorphic base C or T
cttagtctctttgtctttcatgaycttaacagtttcgagaatatctg

SEQ ID NO: 2613 - DNA, 47 bp, Homo Sapiens
  allele 24: 99-12241-380 : polymorphic base T or G
ccagctggactctgcagctccacktggaatccaggtgctgcctccag

SEQ ID NO: 2614 - DNA, 47 bp, Homo Sapiens
  allele 24: 99-12253-145 : polymorphic base T or C
gaaatttcttcttgcaccagcagygtatgagaagtgattaccagtct

SEQ ID NO: 2615 - DNA, 47 bp, Homo Sapiens
  allele 24: 99-12265-324 : polymorphic base A or T
aataagaaggatacagttgtaccwtgcytaaactgaaactgcccatt

SEQ ID NO: 2616 - DNA, 47 bp, Homo Sapiens
  allele 24: 99-12267-161 : polymorphic base G or T
cacatcctttttttctttgaatgktataagtccattttctcatttaa

SEQ ID NO: 2617 - DNA, 47 bp, Homo Sapiens
  allele 24: 99-12268-54 : polymorphic base G or A
acaaaacatatttttgttttcaarcagtttcttattttctttttggt

SEQ ID NO: 2618 - DNA, 47 bp, Homo Sapiens
  allele 24: 99-12270-408 : polymorphic base T or G
gatattgggcttattgtacaaggkttttagagcagctattataatca

SEQ ID NO: 2619 - DNA, 47 bp, Homo Sapiens
  allele 24: 99-12271-298 : polymorphic base G or A
atgctcacttgacctattttaacrgatgttctacaagagcaatgggg

SEQ ID NO: 2620 - DNA, 47 bp, Homo Sapiens
  allele 24: 99-12275-214 : polymorphic base A or T
cttacagatatgtcctagaaattwttctgtattaattcatgatattc

SEQ ID NO: 2621 - DNA, 47 bp, Homo Sapiens
  allele 24: 99-12299-433 : polymorphic base T or G
gtaaagaactcccctggtattttkcttcctatgcttaaggccttatc

SEQ ID NO: 2622 - DNA, 47 bp, Homo Sapiens
  allele 24: 99-12303-460 : polymorphic base C or T
tgctggcagtgacagaagggacaycaactcctgatgtttctttaatg

SEQ ID NO: 2623 - DNA, 47 bp, Homo Sapiens
  allele 24: 99-12335-394 : polymorphic base C or T
ttggccttattttttgtgtttttygcaacaagtttgtttcgcatttg

SEQ ID NO: 2624 - DNA, 47 bp, Homo Sapiens
  allele 24: 99-12338-83 : polymorphic base T or C
agaattttttcccaaccaggctcygggcctcctcctctgtgtggaat

SEQ ID NO: 2625 - DNA, 47 bp, Homo Sapiens
  allele 24: 99-12344-171 : polymorphic base G or C
atttggtatgaaaaggtacagctsactagatattcttcagagccagt

SEQ ID NO: 2626 - DNA, 47 bp, Homo Sapiens
  allele 24: 99-12347-490 : polymorphic base G or C
atctgcagttaaggctcccagctscgacttatattaagatattycct

SEQ ID NO: 2627 - DNA, 47 bp, Homo Sapiens
  allele 24: 99-12348-74 : polymorphic base T or G
aatttctcttcctacctataacaktaactatggatcacaaactgtgt

SEQ ID NO: 2628 - DNA, 47 bp, Homo Sapiens
  allele 24: 99-12352-124 : polymorphic base T or G
ataaatagaaacaacaaaaagttkaaaaaaatcagggggacaaagct

SEQ ID NO: 2629 - DNA, 47 bp, Homo Sapiens
  allele 24: 99-12356-272 : polymorphic base T or C
tagaaatgcactgttgaggtttgyctccctgcctagatggggccttg

SEQ ID NO: 2630 - DNA, 47 bp, Homo Sapiens
  allele 24: 99-12361-88 : polymorphic base T or C
acctggcattatttggaatgcttyatttcctctgtacctggccttca

SEQ ID NO: 2631 - DNA, 47 bp, Homo Sapiens
  allele 24: 99-12368-335 : polymorphic base A or C
ggtgacagtaatacctaccactamggtgttgtgagaattaaatgagg

SEQ ID NO: 2632 - DNA, 47 bp, Homo Sapiens
  allele 24: 99-12370-67 : polymorphic base G or A
tttaaaaggaaaagcagagttcartgcaaattctagaaatagttgtc

SEQ ID NO: 2633 - DNA, 47 bp, Homo Sapiens
  allele 24: 99-12384-135 : polymorphic base G or A
aaatatattgtgttacatagttcrtattatctgataaaaatacatag

SEQ ID NO: 2634 - DNA, 47 bp, Homo Sapiens
  allele 24: 99-12388-466 : polymorphic base G or A
atttttatcaaactaacaagcacratgagattggcttgttgcttcta

SEQ ID NO: 2635 - DNA, 47 bp, Homo Sapiens
  allele 24: 99-12393-326 : polymorphic base A or G
tgggcttgctgacttgggcccccrgtgcagttgccccacccctgcct

SEQ ID NO: 2636 - DNA, 47 bp, Homo Sapiens
  allele 24: 99-12399-180 : polymorphic base C or T
tccaatgatacccagagtcttggytttctaacagggcatcacatttt

SEQ ID NO: 2637 - DNA, 47 bp, Homo Sapiens
  allele 24: 99-12412-381 : polymorphic base T or C
ataacttttcagcctgagttcttyctattttgagtacagcaatagtt

SEQ ID NO: 2638 - DNA, 47 bp, Homo Sapiens
  allele 24: 99-12415-509 : polymorphic base A or G
ctgacttctgacagtttcactgtrattttctttgggaggaccttttt

SEQ ID NO: 2639 - DNA, 47 bp, Homo Sapiens
  allele 24: 99-12444-400 : polymorphic base A or G
ccatcagatgctgtcacttcaccrcttaagtatatgttttcatttat

SEQ ID NO: 2640 - DNA, 47 bp, Homo Sapiens
  allele 24: 99-12465-227 : polymorphic base G or A
ttaaattattgtgtgccacagagrtaacaaatttccttgttaattgt

SEQ ID NO: 2641 - DNA, 47 bp, Homo Sapiens
  allele 24: 99-12468-236 : polymorphic base G or T
cctacaaggtcaaccacacatttkaaaatgattccacactttgggaa

SEQ ID NO: 2642 - DNA, 47 bp, Homo Sapiens
  allele 24: 99-12470-288 : polymorphic base G or A
cttgatatatttctttttccattrgagccaaaaatttacaccttgcc

SEQ ID NO: 2643 - DNA, 47 bp, Homo Sapiens
  allele 24: 99-12522-196 : polymorphic base T or C
aacttttctcttttcccactagaygtgttcctgggacgtttccaaag

SEQ ID NO: 2644 - DNA, 47 bp, Homo Sapiens
  allele 24: 99-12561-278 : polymorphic base C or G
ggggctggccactctctggaggtstagaccttgaggccagagctgga

SEQ ID NO: 2645 - DNA, 47 bp, Homo Sapiens
  allele 24: 99-12570-265 : polymorphic base G or A
tacacgtggtcctttctctcacarcatgtaaaaaatcagctcaacat

SEQ ID NO: 2646 - DNA, 47 bp, Homo Sapiens
  allele 24: 99-12595-313 : polymorphic base C or T
gatgttggctgcattggggccagyagcatgaacagcctcagtcaata

SEQ ID NO: 2647 - DNA, 47 bp, Homo Sapiens
  allele 24: 99-12596-334 : polymorphic base T or C
gagatatgaataagaatttaaaayggtatatatctcctgtataccac

SEQ ID NO: 2648 - DNA, 47 bp, Homo Sapiens
  allele 24: 99-12598-191 : polymorphic base C or A
ggcctcccctgcagctctgtgtgmaggcagcaggcatcggccggtgg

SEQ ID NO: 2649 - DNA, 47 bp, Homo Sapiens
  allele 24: 99-12602-212 : polymorphic base G or T
accaaacatttcattctacctctkcttttagtcattccatgttttaa

SEQ ID NO: 2650 - DNA, 47 bp, Homo Sapiens
  allele 24: 99-12605-365 : polymorphic base C or T
ttaaacttagtgaatttcacagaygtttcttggaatcaagtctttgg

SEQ ID NO: 2651 - DNA, 47 bp, Homo Sapiens
  allele 24: 99-12607-384 : polymorphic base A or G
agattgggataggaatgccacctrcacacagaggaggatttggaatg

SEQ ID NO: 2652 - DNA, 47 bp, Homo Sapiens
  allele 24: 99-12664-222 : polymorphic base C or A
aggcagatacagcctttgcccttmaggcagggaaaatgacatgaagc

SEQ ID NO: 2653 - DNA, 47 bp, Homo Sapiens
  allele 24: 99-12696-116 : polymorphic base T or C
tgtctcctgcttccgtcagggacygaactctgaaatgaagaaggcac

SEQ ID NO: 2654 - DNA, 47 bp, Homo Sapiens
  allele 24: 99-12960-443 : polymorphic base G or A
gtcattaatatatgaaatatacargtaactcctatatttcaacaaaa

SEQ ID NO: 2655 - DNA, 47 bp, Homo Sapiens
  allele 24: 99-12965-451 : polymorphic base C or T
tacaagtggactttttggaggacyatttccaagaagaagaaagcaaa

SEQ ID NO: 2656 - DNA, 47 bp, Homo Sapiens
  allele 24: 99-12969-128 : polymorphic base C or T
gatctttggagacacacaaactgytagcttcttgtcctcaaggagag

SEQ ID NO: 2657 - DNA, 47 bp, Homo Sapiens
  allele 24: 99-12970-339 : polymorphic base A or G
atttcaaggtggcaatccaccatrgaagccaaaaaatgacttacacc

SEQ ID NO: 2658 - DNA, 47 bp, Homo Sapiens
  allele 24: 99-12973-162 : polymorphic base G or A
aaaaacatttcatctgtttgcatrtgagtgattgggacaagcccttt

SEQ ID NO: 2659 - DNA, 47 bp, Homo Sapiens
  allele 24: 99-13074-132 : polymorphic base T or C
tttgtgggcacccatagtaaatayataactttatatcatgctgaaga

SEQ ID NO: 2660 - DNA, 47 bp, Homo Sapiens
  allele 24: 99-13077-340 : polymorphic base C or T
atacgctttattattcacctcagytggatttattgtgcctcacaggt

SEQ ID NO: 2661 - DNA, 47 bp, Homo Sapiens
  allele 24: 99-1311-59 : polymorphic base C or G
tcaggaaattattgatcattattstagaatattggagaaatcattta

SEQ ID NO: 2662 - DNA, 47 bp, Homo Sapiens
  allele 24: 99-13113-234 : polymorphic base G or A
attaataacacatcatgaattttraattcatgagtagttactgcata

SEQ ID NO: 2663 - DNA, 47 bp, Homo Sapiens
  allele 24: 99-13205-67 : polymorphic base T or A
tgtgaataaaaaatctgtatcaawacaagataaactattaccttctt

SEQ ID NO: 2664 - DNA, 47 bp, Homo Sapiens
  allele 24: 99-1326-203 : polymorphic base C or T
ttcataatcagtaatacttgacayggtgtaccaagaagaaaaaatga

SEQ ID NO: 2665 - DNA, 47 bp, Homo Sapiens
  allele 24: 99-1333-123 : polymorphic base C or G
atataggtaatttgtattgttttstagttcttgaacactctaggtgt

SEQ ID NO: 2666 - DNA, 47 bp, Homo Sapiens
  allele 24: 99-1335-195 : polymorphic base A or G
catacattggcacactcccgcaarcaacacctagcatggtgccccca

SEQ ID NO: 2667 - DNA, 47 bp, Homo Sapiens
  allele 24: 99-13350-376 : polymorphic base T or G
aatggtatgctaagagactgattktattgccaatagcataatgaaaa

SEQ ID NO: 2668 - DNA, 47 bp, Homo Sapiens
  allele 24: 99-13376-288 : polymorphic base A or T
ttgaatgatatcttactcaaaggwactgtctggaggcagccttggtt

SEQ ID NO: 2669 - DNA, 47 bp, Homo Sapiens
  allele 24: 99-13473-135 : polymorphic base C or T
ttctcttctgtaaaatgagaggtyggaaaagcagatgatgtgctttc

SEQ ID NO: 2670 - DNA, 47 bp, Homo Sapiens
  allele 24: 99-13530-325 : polymorphic base T or C
aaactttctacatctatatcccayccttttccctgtttttataaaac

SEQ ID NO: 2671 - DNA, 47 bp, Homo Sapiens
  allele 24: 99-13563-83 : polymorphic base C or T
gttcactagttgctttttcaagayaagaaagttatttttttaatgta

SEQ ID NO: 2672 - DNA, 47 bp, Homo Sapiens
  allele 24: 99-13579-242 : polymorphic base G or C
caaagagaaggtaaattcattcasgatgatgatgaactcagttagaa

SEQ ID NO: 2673 - DNA, 47 bp, Homo Sapiens
  allele 24: 99-13609-327 : polymorphic base T or C
ttaagcagtcattaatttttaaaycagcgcttggctgagagaatgct

SEQ ID NO: 2674 - DNA, 47 bp, Homo Sapiens
  allele 24: 99-13621-358 : polymorphic base T or C
gcatgcttttctcccacttgtcaygttaaagtaatgatcacatccag

SEQ ID NO: 2675 - DNA, 47 bp, Homo Sapiens
  allele 24: 99-1370-401 : polymorphic base A or G
cctgatgattcccaaattgattcrctagttccagcttccctgcctgt

SEQ ID NO: 2676 - DNA, 47 bp, Homo Sapiens
  allele 24: 99-13864-64 : polymorphic base G or T
tccccccttccctcctcccacagkctgccctcctcccccttgcacac

SEQ ID NO: 2677 - DNA, 47 bp, Homo Sapiens
  allele 24: 99-13938-286 : polymorphic base T or C
gctgccagttacatgtcggactcyaaagtcaacagccctgacaagtg

SEQ ID NO: 2678 - DNA, 47 bp, Homo Sapiens
  allele 24: 99-13943-247 : polymorphic base T or C
aaggagagagcttccatggtggcycactgcctggagcacaaggacga

SEQ ID NO: 2679 - DNA, 47 bp, Homo Sapiens
  allele 24: 99-13948-182 : polymorphic base T or A
ctgtgacacgggtcctgtctgccwctccgggttgttatggatggaga

SEQ ID NO: 2680 - DNA, 47 bp, Homo Sapiens
  allele 24: 99-13966-334 : polymorphic base T or C
agtgtcaagtgagtgcgacttttygtccctgtgtctatggccaaaag

SEQ ID NO: 2681 - DNA, 47 bp, Homo Sapiens
  allele 24: 99-14002-395 : polymorphic base C or G
aaaccctgaagggcagtgttaaasaatgggataaccttgaaatatag

SEQ ID NO: 2682 - DNA, 47 bp, Homo Sapiens
  allele 24: 99-14022-347 : polymorphic base C or T
atcgcttataaaatggaatctctygagataagattttgaaggcaaat

SEQ ID NO: 2683 - DNA, 47 bp, Homo Sapiens
  allele 24: 99-14042-464 : polymorphic base G or A
ctttcccccaataacatgttgctrtgttagcattaacttgctgaccc

SEQ ID NO: 2684 - DNA, 47 bp, Homo Sapiens
  allele 24: 99-14045-353 : polymorphic base T or C
ataagtacaaatgttttaatctgygatttgtattacacttgcagggt

SEQ ID NO: 2685 - DNA, 47 bp, Homo Sapiens
  allele 24: 99-14074-326 : polymorphic base C or T
gggtggaagtgggctgaattctayatgctacttagtgacgtaaggac

SEQ ID NO: 2686 - DNA, 47 bp, Homo Sapiens
  allele 24: 99-14093-333 : polymorphic base T or C
atgtgtgaacaactgttattaaaygtgtatgaaagttgggcagggga

SEQ ID NO: 2687 - DNA, 47 bp, Homo Sapiens
  allele 24: 99-14105-357 : polymorphic base G or C
gaaatagacatgtagcagctacastgtagattcaaaaggaaatgaag

SEQ ID NO: 2688 - DNA, 47 bp, Homo Sapiens
  allele 24: 99-14107-175 : polymorphic base A or G
gttgtatatttagctcatgagacrgtgctccaacagacccaccacat

SEQ ID NO: 2689 - DNA, 47 bp, Homo Sapiens
  allele 24: 99-14111-346 : polymorphic base C or G
aaggaaaaagagagacagagacasagatcatagtaaggatggtggta

SEQ ID NO: 2690 - DNA, 47 bp, Homo Sapiens
  allele 24: 99-14177-226 : polymorphic base A or G
attttgcttatgtctggccctgtrtctgctctgaacaccccactgct

SEQ ID NO: 2691 - DNA, 47 bp, Homo Sapiens
  allele 24: 99-14198-374 : polymorphic base T or G
attacataccagggtaatcttcckttcaattaactttttcaatacat

SEQ ID NO: 2692 - DNA, 47 bp, Homo Sapiens
  allele 24: 99-14225-345 : polymorphic base T or C
cttgcacaataggtaatattaaayacatgcttatatgcctttgcact

SEQ ID NO: 2693 - DNA, 47 bp, Homo Sapiens
  allele 24: 99-14228-387 : polymorphic base C or G
gaatcctgcaggttcttaggggtsgggtcttaaggtttccagacgac

SEQ ID NO: 2694 - DNA, 47 bp, Homo Sapiens
  allele 24: 99-14410-373 : polymorphic base T or C
gcttccgcatgtgtctctgtcctyggctggctttcatctgtttcctt

SEQ ID NO: 2695 - DNA, 47 bp, Homo Sapiens
  allele 24: 99-14413-383 : polymorphic base T or G
agaccctgatcctggatggcaagktactcatctttacccactgggac

SEQ ID NO: 2696 - DNA, 47 bp, Homo Sapiens
  allele 24: 99-14415-106 : polymorphic base C or T
gagcagtccttaacctcgagggaygggaacgggagcacccagcttcc

SEQ ID NO: 2697 - DNA, 47 bp, Homo Sapiens
  allele 24: 99-14424-353 : polymorphic base G or A
cctgaactgacgtggtagcacacracatggctttaggccccaaacaa

SEQ ID NO: 2698 - DNA, 47 bp, Homo Sapiens
  allele 24: 99-14473-243 : polymorphic base A or C
taaatccaatgatgcttctgtggmtcatgtcaaagtagccactgact

SEQ ID NO: 2699 - DNA, 47 bp, Homo Sapiens
  allele 24: 99-14476-377 : polymorphic base T or G
cagtacagaccctcaatttctgtkctgggggccagaggtggccaagg

SEQ ID NO: 2700 - DNA, 47 bp, Homo Sapiens
  allele 24: 99-14481-386 : polymorphic base T or C
tcaaattgggcttatcatcttttycctaataaaagtttttatcagtc

SEQ ID NO: 2701 - DNA, 47 bp, Homo Sapiens
  allele 24: 99-14489-415 : polymorphic base G or T
tgaggaccaaatagatgtaggttkgttagaatcaccacaaaatgcta

SEQ ID NO: 2702 - DNA, 47 bp, Homo Sapiens
  allele 24: 99-14673-334 : polymorphic base A or G
aagaatttataaaacggagtaacraattgcaatctattaaacactag

SEQ ID NO: 2703 - DNA, 47 bp, Homo Sapiens
  allele 24: 99-14705-290 : polymorphic base A or G
cctcaaccctggagaatgtatagrggagtgagaagcgccatggatga

SEQ ID NO: 2704 - DNA, 47 bp, Homo Sapiens
  allele 24: 99-14739-205 : polymorphic base C or G
aaatcatgcataaatatctacctstgccagagggatcttaaaaatgg

SEQ ID NO: 2705 - DNA, 47 bp, Homo Sapiens
  allele 24: 99-14743-418 : polymorphic base C or T
aatcgtggtggtggattcctcttytgtgtagcacccaggaaacataa

SEQ ID NO: 2706 - DNA, 47 bp, Homo Sapiens
  allele 24: 99-14944-119 : polymorphic base A or C
tagatatagcagagggccactcamctgggaagttttcccaaataatc

SEQ ID NO: 2707 - DNA, 47 bp, Homo Sapiens
  allele 24: 99-14949-472 : polymorphic base G or A
tttatgatgggaaaatctgaaagrcatactctcccctcaatctattg

SEQ ID NO: 2708 - DNA, 47 bp, Homo Sapiens
  allele 24: 99-15000-259 : polymorphic base C or T
tcctggaatgaccctgagtctttyctgcttgagaaattcctaatctg

SEQ ID NO: 2709 - DNA, 47 bp, Homo Sapiens
  allele 24: 99-15067-278 : polymorphic base T or C
taaaacaacacaagattgatttayctatgagcactgtttctattaca

SEQ ID NO: 2710 - DNA, 47 bp, Homo Sapiens
  allele 24: 99-15192-224 : polymorphic base C or T
gatgctgtccaaggaggacaccaytgaacacttcatgaaattatatg

SEQ ID NO: 2711 - DNA, 47 bp, Homo Sapiens
  allele 24: 99-15369-90 : polymorphic base C or T
tacttcctaaagctcctgtctttyaaaactatcacaatggcaattaa

SEQ ID NO: 2712 - DNA, 47 bp, Homo Sapiens
  allele 24: 99-15423-223 : polymorphic base G or A
tatatgataatgctgatgtaggtrtaacatctatattgcccatattt

SEQ ID NO: 2713 - DNA, 47 bp, Homo Sapiens
  allele 24: 99-15471-316 : polymorphic base G or T
cagacatttggattctcagatctkcttctgcatccaatctgttacgg

SEQ ID NO: 2714 - DNA, 47 bp, Homo Sapiens
  allele 24: 99-15538-250 : polymorphic base T or C
cttttataagagtcataatcccaytcatgaaggacatgccctcaaat

SEQ ID NO: 2715 - DNA, 47 bp, Homo Sapiens
  allele 24: 99-15588-430 : polymorphic base A or G
cacagtaggagaacaaggctaatrtgaccttgtgtgtgagcctgtta

SEQ ID NO: 2716 - DNA, 47 bp, Homo Sapiens
  allele 24: 99-15615-368 : polymorphic base G or A
tcacctcagtcttcccaagtatgrctactggcctcttctggatgtct

SEQ ID NO: 2717 - DNA, 47 bp, Homo Sapiens
  allele 24: 99-15653-359 : polymorphic base G or A
gcaaacttacctccattccttgcrccctttccctccttacagctgtt

SEQ ID NO: 2718 - DNA, 47 bp, Homo Sapiens
  allele 24: 99-15654-122 : polymorphic base G or A
agccaggcctaaacctggattatrcaaacttgaaactatcttgaaat

SEQ ID NO: 2719 - DNA, 47 bp, Homo Sapiens
  allele 24: 99-15724-147 : polymorphic base C or T
tgtgtattgactgcaaatactttygtaaagttattccttcgtatatt

SEQ ID NO: 2720 - DNA, 47 bp, Homo Sapiens
  allele 24: 99-15784-28 : polymorphic base G or T
aaaatggcaacatactacaatatkttttctaacaatctaccatgacc

SEQ ID NO: 2721 - DNA, 47 bp, Homo Sapiens
  allele 24: 99-1591-235 : polymorphic base G or A
gtccgaggtgattttctcccactrctctcctaggtggtgccatccaa

SEQ ID NO: 2722 - DNA, 47 bp, Homo Sapiens
  allele 24: 99-15963-394 : polymorphic base A or G
cagggatgtacattatgtacattrtacatctctttattgtctgagtc

SEQ ID NO: 2723 - DNA, 47 bp, Homo Sapiens
  allele 24: 99-15984-100 : polymorphic base A or G
aagggaatcaagaaaagtagttcrtgactcaataatctcaagtacca

SEQ ID NO: 2724 - DNA, 47 bp, Homo Sapiens
  allele 24: 99-16017-426 : polymorphic base C or T
aacgtacatctgtttagaaattaytgaaagaaatcataacgcataac

SEQ ID NO: 2725 - DNA, 47 bp, Homo Sapiens
  allele 24: 99-16026-359 : polymorphic base G or A
ctcacctgaaggtttgcctccacragctggggagaacaagaaccact

SEQ ID NO: 2726 - DNA, 47 bp, Homo Sapiens
  allele 24: 99-1624-377 : polymorphic base G or A
aatttctataaagttttaaaaagraaaaaaaagcctaccgtaaagta

SEQ ID NO: 2727 - DNA, 47 bp, Homo Sapiens
  allele 24: 99-16241-126 : polymorphic base T or G
tttatagatttagcccaatggggkcataaagctgatttgaggtcacc

SEQ ID NO: 2728 - DNA, 47 bp, Homo Sapiens
  allele 24: 99-16259-304 : polymorphic base A or C
cttcattttagagttagatgcacmgcattattgtggcaatagctaca

SEQ ID NO: 2729 - DNA, 47 bp, Homo Sapiens
  allele 24: 99-16284-389 : polymorphic base T or C
ctttaggtcctgcagcagtatggyaccagtttgaaagcctccatcca

SEQ ID NO: 2730 - DNA, 47 bp, Homo Sapiens
  allele 24: 99-16343-30 : polymorphic base T or C
ctgtgtcatcctgggggcagtgtytctccacggccacagcccaggag

SEQ ID NO: 2731 - DNA, 47 bp, Homo Sapiens
  allele 24: 99-16401-88 : polymorphic base C or T
agtggagataattgcgcctgtgcyttattagttctaatgtttagctt

SEQ ID NO: 2732 - DNA, 47 bp, Homo Sapiens
  allele 24: 99-16406-349 : polymorphic base C or T
atgaataattcagggaatccctgytcccaataattcttcagttttga

SEQ ID NO: 2733 - DNA, 47 bp, Homo Sapiens
  allele 24: 99-16422-240 : polymorphic base A or G
accttggtgcagaatgtggttccrttccctgaggagaaggaacactg

SEQ ID NO: 2734 - DNA, 47 bp, Homo Sapiens
  allele 24: 99-16428-275 : polymorphic base C or T
tgtggctgatccctgggagactgyatcgtttctttgtctcatactct

SEQ ID NO: 2735 - DNA, 47 bp, Homo Sapiens
  allele 24: 99-16430-358 : polymorphic base T or G
tctagaatccctaatgtccaaagkcccgaaaattccaatcacaggat

SEQ ID NO: 2736 - DNA, 47 bp, Homo Sapiens
  allele 24: 99-16432-114 : polymorphic base T or A
atagttgagctgtctcgaactctwtcagaatgtctcaatgttataac

SEQ ID NO: 2737 - DNA, 47 bp, Homo Sapiens
  allele 24: 99-16647-382 : polymorphic base T or C
gctgcctcctctctgcacggaaayggcagttagaaaaactgaggttg

SEQ ID NO: 2738 - DNA, 47 bp, Homo Sapiens
  allele 24: 99-16661-147 : polymorphic base G or A
ccaagttctacagcagattaaaartaatacaggtttctttcggggaa

SEQ ID NO: 2739 - DNA, 47 bp, Homo Sapiens
  allele 24: 99-16686-82 : polymorphic base A or C
tgcctcatgtaagtcacaagaagmagcagcatagaaatatgctcaga

SEQ ID NO: 2740 - DNA, 47 bp, Homo Sapiens
  allele 24: 99-16714-82 : polymorphic base G or A
aaaaacaatcctgtgggatatcartatttacaaatcaggcagaggat

SEQ ID NO: 2741 - DNA, 47 bp, Homo Sapiens
  allele 24: 99-16735-210 : polymorphic base A or G
ttttttaattcattctcattgccrtctctgcctgtcaccacctgaaa

SEQ ID NO: 2742 - DNA, 47 bp, Homo Sapiens
  allele 24: 99-16739-245 : polymorphic base G or A
atatataaagtgagactcttattrgaaatattaacaagattaatgct

SEQ ID NO: 2743 - DNA, 47 bp, Homo Sapiens
  allele 24: 99-16751-318 : polymorphic base A or T
ggcatacatttggggttgtgcccwgctcagggcagctggacagcagt

SEQ ID NO: 2744 - DNA, 47 bp, Homo Sapiens
  allele 24: 99-16752-78 : polymorphic base C or G
gggcagagaaagaagaaattgctsttgcacctcccaaaagcattttg

SEQ ID NO: 2745 - DNA, 47 bp, Homo Sapiens
  allele 24: 99-16754-63 : polymorphic base A or G
aatagaagggacagagggaggacrcagtgaactggaagacagaaaaa

SEQ ID NO: 2746 - DNA, 47 bp, Homo Sapiens
  allele 24: 99-16758-60 : polymorphic base G or T
tatatgagaacattttgatatatktgtctggtttgaaactgttctat

SEQ ID NO: 2747 - DNA, 47 bp, Homo Sapiens
  allele 24: 99-16761-370 : polymorphic base A or G
ttggaaaacctcagcctgatagcrcaggaactgagaaattaattctg

SEQ ID NO: 2748 - DNA, 47 bp, Homo Sapiens
  allele 24: 99-16769-459 : polymorphic base G or A
aggctggtggattgcctgaggtcrggagtttgagaaattctgaatct

SEQ ID NO: 2749 - DNA, 47 bp, Homo Sapiens
  allele 24: 99-16771-222 : polymorphic base C or A
tttatgatatgaattttggttcamcttccatagctgtacttcttcat

SEQ ID NO: 2750 - DNA, 47 bp, Homo Sapiens
  allele 24: 99-16772-36 : polymorphic base T or C
gaaaaggcctacagttaccgtggygaccaggtaactgtgcacagaca

SEQ ID NO: 2751 - DNA, 47 bp, Homo Sapiens
  allele 24: 99-16774-183 : polymorphic base G or T
tggtagaagcattcacatttacakccttgcttaatcttacggtgtat

SEQ ID NO: 2752 - DNA, 47 bp, Homo Sapiens
  allele 24: 99-16776-275 : polymorphic base C or G
tgtcaggatggctcaacagacatsaccaggaaaacagagaaaagaaa

SEQ ID NO: 2753 - DNA, 47 bp, Homo Sapiens
  allele 24: 99-16794-291 : polymorphic base A or T
gagccttatataagacacagctcwgcatgtgatttagataataagca

SEQ ID NO: 2754 - DNA, 47 bp, Homo Sapiens
  allele 24: 99-16797-385 : polymorphic base G or A
gcaggataaaactctacatgaccrgcaagaaaaacgtgcaggaaaga

SEQ ID NO: 2755 - DNA, 47 bp, Homo Sapiens
  allele 24: 99-16815-282 : polymorphic base G or A
atgagtcccctgcctcttttgctrcagaaattcttttagctcatatg

SEQ ID NO: 2756 - DNA, 47 bp, Homo Sapiens
  allele 24: 99-16835-413 : polymorphic base G or A
aagtgactcagtgataggtgtaargcctgatagctatgtgacttcat

SEQ ID NO: 2757 - DNA, 47 bp, Homo Sapiens
  allele 24: 99-16909-151 : polymorphic base T or C
cagtgttcactacctgaaattcaytggtttgtggctgtgactgccca

SEQ ID NO: 2758 - DNA, 47 bp, Homo Sapiens
  allele 24: 99-17024-215 : polymorphic base C or T
ttggagggctgtcctgtggactayaagatgtttagcagcatccgtgg

SEQ ID NO: 2759 - DNA, 47 bp, Homo Sapiens
  allele 24: 99-17046-162 : polymorphic base A or C
ttttcacttctcgttgctgagatmtggctacatcaggatacccaact

SEQ ID NO: 2760 - DNA, 47 bp, Homo Sapiens
  allele 24: 99-17075-173 : polymorphic base C or T
aaagcagatgcacagaagactgaygtcagctgtactaatggataaat

SEQ ID NO: 2761 - DNA, 47 bp, Homo Sapiens
  allele 24: 99-17107-271 : polymorphic base G or T
tttcacttatttataaattttatktatgcactgaatgaatactcatt

SEQ ID NO: 2762 - DNA, 47 bp, Homo Sapiens
  allele 24: 99-17162-81 : polymorphic base G or T
gtgataccccaatacgtattacakgctttcttgtgttttccccacag

SEQ ID NO: 2763 - DNA, 47 bp, Homo Sapiens
  allele 24: 99-17167-55 : polymorphic base A or G
tgtccacacttttttctcttaatrcataacttcctgataccaaagaa

SEQ ID NO: 2764 - DNA, 47 bp, Homo Sapiens
  allele 24: 99-17214-451 : polymorphic base T or C
ccattttctgtgactgaagtcaaygaaaatctacaattactcaatta

SEQ ID NO: 2765 - DNA, 47 bp, Homo Sapiens
  allele 24: 99-17254-339 : polymorphic base G or A
ccatctgttatcattggccccctrggaagcaggttggaggagatagg

SEQ ID NO: 2766 - DNA, 47 bp, Homo Sapiens
  allele 24: 99-17402-339 : polymorphic base G or A
taaccctgtggtacagctgggtcrttctggaaggaatctcrtagaca

SEQ ID NO: 2767 - DNA, 47 bp, Homo Sapiens
  allele 24: 99-17492-271 : polymorphic base T or C
gggcatctcaggtggagggcagaygccgggaatggcttttctaaaag

SEQ ID NO: 2768 - DNA, 47 bp, Homo Sapiens
  allele 24: 99-17519-116 : polymorphic base G or A
tacgaaacccggaaacagctcctrgaaggccctctgagctttgaaat

SEQ ID NO: 2769 - DNA, 47 bp, Homo Sapiens
  allele 24: 99-17581-374 : polymorphic base G or A
gaagagcaaaatgaagactaagarggacacagaagaagaacttgaca

SEQ ID NO: 2770 - DNA, 47 bp, Homo Sapiens
  allele 24: 99-17716-400 : polymorphic base C or T
aggcagtaagaataatagcctgaygaaaggttaacgttttaatgtac

SEQ ID NO: 2771 - DNA, 47 bp, Homo Sapiens
  allele 24: 99-18122-403 : polymorphic base C or T
cttggcctcagagaactgggtgtyggctgcagccaagttttaaggga

SEQ ID NO: 2772 - DNA, 47 bp, Homo Sapiens
  allele 24: 99-18126-160 : polymorphic base A or T
tctggtccctgagcctggggtcawgtctcctctggggtggctccagc

SEQ ID NO: 2773 - DNA, 47 bp, Homo Sapiens
  allele 24: 99-18127-283 : polymorphic base A or G
tggatgagctgttcagggggcagrtatggaattaatgcagacacgaa

SEQ ID NO: 2774 - DNA, 47 bp, Homo Sapiens
  allele 24: 99-18141-152 : polymorphic base T or C
acagccagggctcacctctgtgtycctagccatcgtggtacacagcc

SEQ ID NO: 2775 - DNA, 47 bp, Homo Sapiens
  allele 24: 99-18190-317 : polymorphic base G or A
tcagtagtatttttcctttagggrtgtcatcttggctcttcttaacc

SEQ ID NO: 2776 - DNA, 47 bp, Homo Sapiens
  allele 24: 99-18321-371 : polymorphic base T or C
ctacgtgctaaatagtgataattyttgttcataatgataactccaag

SEQ ID NO: 2777 - DNA, 47 bp, Homo Sapiens
  allele 24: 99-1833-56 : polymorphic base T or C
gggacatgcttctggttagtggaygaatgctgatcattcattttggg

SEQ ID NO: 2778 - DNA, 47 bp, Homo Sapiens
  allele 24: 99-18334-485 : polymorphic base A or G
aaggtattgggacttctgacttgrgtgctgaagaaaatccccttctg

SEQ ID NO: 2779 - DNA, 47 bp, Homo Sapiens
  allele 24: 99-18396-324 : polymorphic base A or C
ggtgacctcaaatcagctttatgmccccattgggctaaatctataaa

SEQ ID NO: 2780 - DNA, 47 bp, Homo Sapiens
  allele 24: 99-18471-410 : polymorphic base A or G
attttaccaactttctgttctgarctaatttaaaatttatgtttcca

SEQ ID NO: 2781 - DNA, 47 bp, Homo Sapiens
  allele 24: 99-18528-195 : polymorphic base G or A
tagacactagggatattatgaggracaagagatatgaaccctgcccc

SEQ ID NO: 2782 - DNA, 47 bp, Homo Sapiens
  allele 24: 99-18576-182 : polymorphic base A or C
tcatatcacagcctttagatcctmctgggtagagttcagagctggat

SEQ ID NO: 2783 - DNA, 47 bp, Homo Sapiens
  allele 24: 99-18581-34 : polymorphic base T or C
tcagatgccacctcgccccacccygagctggcctacctgcacccggg

SEQ ID NO: 2784 - DNA, 47 bp, Homo Sapiens
  allele 24: 99-18645-309 : polymorphic base G or A
tagcttggcctgcctgggcttcartctacctccctctttcccattaa

SEQ ID NO: 2785 - DNA, 47 bp, Homo Sapiens
  allele 24: 99-18696-213 : polymorphic base T or C
acccctaggagcctgttcactctyccccatcattaggagcactttga

SEQ ID NO: 2786 - DNA, 47 bp, Homo Sapiens
  allele 24: 99-18698-346 : polymorphic base C or G
ttataaatctcatattaatccttstgtgcttgttttgtctgttgtta

SEQ ID NO: 2787 - DNA, 47 bp, Homo Sapiens
  allele 24: 99-18710-208 : polymorphic base C or T
tttcatagatgccagcagggcatyaggcactgagggtattgtgaaca

SEQ ID NO: 2788 - DNA, 47 bp, Homo Sapiens
  allele 24: 99-18717-319 : polymorphic base T or A
agaactttcatcagattctcagcwgagaatgtgaagtatacttaagt

SEQ ID NO: 2789 - DNA, 47 bp, Homo Sapiens
  allele 24: 99-18718-362 : polymorphic base C or G
tatattgttttcatcctttctttsgtgggtgtaagtgtggccaagta

SEQ ID NO: 2790 - DNA, 47 bp, Homo Sapiens
  allele 24: 99-18771-300 : polymorphic base C or T
tgtcattagaaaggaaggcctctygtttacgctactgtgattcacag

SEQ ID NO: 2791 - DNA, 47 bp, Homo Sapiens
  allele 24: 99-1879-393 : polymorphic base G or A
aagcctaatatttgaggacagtcrgcatgcacgcaagaatgctttac

SEQ ID NO: 2792 - DNA, 47 bp, Homo Sapiens
  allele 24: 99-18886-50 : polymorphic base T or A
ggtggatgtaaccagtacattagwtgtaaaatagaggctaaacaata

SEQ ID NO: 2793 - DNA, 47 bp, Homo Sapiens
  allele 24: 99-18944-242 : polymorphic base C or T
tcaccccatgaatagagcctgctyttctggcagtatgtggtttgttc

SEQ ID NO: 2794 - DNA, 47 bp, Homo Sapiens
  allele 24: 99-19023-347 : polymorphic base T or C
ctcagcttaggtacagggtgaccyagaggggttggaaattaaagtcc

SEQ ID NO: 2795 - DNA, 47 bp, Homo Sapiens
  allele 24: 99-19027-222 : polymorphic base A or G
ccactactgcctccttggttcaarcaaccattatttcttgcctggat

SEQ ID NO: 2796 - DNA, 47 bp, Homo Sapiens
  allele 24: 99-19033-208 : polymorphic base G or T
agtacagagtcacctaggggacckcgttaaaatgcagcttccggacc

SEQ ID NO: 2797 - DNA, 47 bp, Homo Sapiens
  allele 24: 99-19040-395 : polymorphic base A or G
tctgcagttttccagcatattttrtcatacttctgctgtttcaggaa

SEQ ID NO: 2798 - DNA, 47 bp, Homo Sapiens
  allele 24: 99-19041-87 : polymorphic base A or G
tttttatgatcactctaacatctrtcatgccaattttaaaggcatct

SEQ ID NO: 2799 - DNA, 47 bp, Homo Sapiens
  allele 24: 99-19048-487 : polymorphic base C or T
tccaggcctattggattgtatgcygcttccaatccattatatcaact

SEQ ID NO: 2800 - DNA, 47 bp, Homo Sapiens
  allele 24: 99-19050-251 : polymorphic base T or C
gacatgttttgtcatcccaactaygacttcttgaatgggcaggctag

SEQ ID NO: 2801 - DNA, 47 bp, Homo Sapiens
  allele 24: 99-19053-241 : polymorphic base T or A
tgacatttcttttgtcagcttccwtatcatggtttatctagggccca

SEQ ID NO: 2802 - DNA, 47 bp, Homo Sapiens
  allele 24: 99-19055-264 : polymorphic base T or C
aaggcatgtatgacgacacatggyggcacaaagaaaagagtggcctg

SEQ ID NO: 2803 - DNA, 47 bp, Homo Sapiens
  allele 24: 99-19059-347 : polymorphic base C or A
gacatatgaactcctctgcacagmctgccctctggggtggaagctgc

SEQ ID NO: 2804 - DNA, 47 bp, Homo Sapiens
  allele 24: 99-19069-44 : polymorphic base C or T
gkttycccgactctaccctgtcaygtctccctgtggttttctgtgac

SEQ ID NO: 2805 - DNA, 47 bp, Homo Sapiens
  allele 24: 99-19095-106 : polymorphic base T or C
tgttatctacacattgtgaagcayattgatttctcctctgtagcctt

SEQ ID NO: 2806 - DNA, 47 bp, Homo Sapiens
  allele 24: 99-19096-317 : polymorphic base A or G
aggttccaggtgatctaagccttrcccttctctcatacctagttaat

SEQ ID NO: 2807 - DNA, 47 bp, Homo Sapiens
  allele 24: 99-19104-66 : polymorphic base T or C
tttatgtttttgctcatgtcacaytccaatacaatttatgagagaca

SEQ ID NO: 2808 - DNA, 47 bp, Homo Sapiens
  allele 24: 99-19105-114 : polymorphic base A or G
cataagaatcagtagcttgagtcrgaggcagcactttttatttacat

SEQ ID NO: 2809 - DNA, 47 bp, Homo Sapiens
  allele 24: 99-19108-156 : polymorphic base C or T
atgctttccttctctctagaacaygcactacgcatgttaaggaggaa

SEQ ID NO: 2810 - DNA, 47 bp, Homo Sapiens
  allele 24: 99-19110-175 : polymorphic base A or G
gcagccagtctctcagtttgctgrtgtcttatttcaattctgtgaga

SEQ ID NO: 2811 - DNA, 47 bp, Homo Sapiens
  allele 24: 99-19122-58 : polymorphic base A or G
tgggataagaagaagaaagaaacrtttaggctgataatgtgatgttg

SEQ ID NO: 2812 - DNA, 47 bp, Homo Sapiens
  allele 24: 99-19123-242 : polymorphic base A or G
gactaatatgcaggcagactaatraacccaatcagatttttaaaatt

SEQ ID NO: 2813 - DNA, 47 bp, Homo Sapiens
  allele 24: 99-19130-86 : polymorphic base T or C
aagtgtacaatattacacttttcyaaaggaacaatttcattaaaaat

SEQ ID NO: 2814 - DNA, 47 bp, Homo Sapiens
  allele 24: 99-19137-156 : polymorphic base C or T
ccaaggaacccataaatagccatytgtcttctatgtaatttcaagat

SEQ ID NO: 2815 - DNA, 47 bp, Homo Sapiens
  allele 24: 99-19142-245 : polymorphic base T or C
ggggagagaagtggtgttatgggycaccccgtcagctaagctcttct

SEQ ID NO: 2816 - DNA, 47 bp, Homo Sapiens; identical to SEQ ID NO: 2814
  allele 24: 99-19154-146 : polymorphic base C or T

SEQ ID NO: 2817 - DNA, 47 bp, Homo Sapiens
  allele 24: 99-19155-75 : polymorphic base A or G
actaaggcagagcagccactgggrgaagaggaaagctggtgttgtct

SEQ ID NO: 2818 - DNA, 47 bp, Homo Sapiens
  allele 24: 99-19167-269 : polymorphic base A or G
ccagaccagagaggtcagtcactrtatcctttccgaaggtccaggaa

SEQ ID NO: 2819 - DNA, 47 bp, Homo Sapiens
  allele 24: 99-19170-193 : polymorphic base A or G
ctgtagtcaagatgccacaactgrtacagtgggtgaaactggactat

SEQ ID NO: 2820 - DNA, 47 bp, Homo Sapiens
  allele 24: 99-19171-120 : polymorphic base G or A
gggtccaggaggccagggttgtaraactatgaaagtcaaccctgcct

SEQ ID NO: 2821 - DNA, 47 bp, Homo Sapiens
  allele 24: 99-19175-150 : polymorphic base G or A
atgctgaccctgcccctggagacrtagggcagggctgccacctcctt

SEQ ID NO: 2822 - DNA, 47 bp, Homo Sapiens
  allele 24: 99-19177-425 : polymorphic base C or T
gaagtgaagccatatcccatgcgycactcccatgcaaattcccaggt

SEQ ID NO: 2823 - DNA, 47 bp, Homo Sapiens
  allele 24: 99-19178-163 : polymorphic base T or C
agggagctggacagatgtccttaytgagaggacaaagagagatggaa

SEQ ID NO: 2824 - DNA, 44 bp, Homo Sapiens
  allele 24: 99-19210-502 : polymorphic base A or G
tgagcatgcgtatgcaccctctcrccttctgtgtgaacactgtc

SEQ ID NO: 2825 - DNA, 47 bp, Homo Sapiens
  allele 24: 99-19219-316 : polymorphic base G or A
taataatttgcccatatctgcacrgtcagcggcagagtcagaatctc

SEQ ID NO: 2826 - DNA, 47 bp, Homo Sapiens
  allele 24: 99-19220-220 : polymorphic base T or C
agctatgtaaacctgggttaattyttactcattcttctaatttagct

SEQ ID NO: 2827 - DNA, 47 bp, Homo Sapiens
  allele 24: 99-19223-238 : polymorphic base C or T
gtctgtgtggtcagctgtgcctaytgggcaccatgcgctgtgctaga

SEQ ID NO: 2828 - DNA, 47 bp, Homo Sapiens
  allele 24: 99-19226-169 : polymorphic base A or G
tgggggtcctcttaccatctgtcrgtggtgttgatgagagtggagat

SEQ ID NO: 2829 - DNA, 47 bp, Homo Sapiens
  allele 24: 99-19228-319 : polymorphic base G or A
cagcacttctgcggcctccttgtrctatgaagatcttttggcagcct

SEQ ID NO: 2830 - DNA, 47 bp, Homo Sapiens
  allele 24: 99-19236-409 : polymorphic base G or A
gtgaggagctgatttatgctgacrcagcccactgcatttttcagggg

SEQ ID NO: 2831 - DNA, 47 bp, Homo Sapiens
  allele 24: 99-19241-362 : polymorphic base C or T
aatttggaagaatgtcactcattyctaatcagaacaccatgattata

SEQ ID NO: 2832 - DNA, 47 bp, Homo Sapiens
  allele 24: 99-19242-254 : polymorphic base G or A
agatgggcggatttttgcttcatrtttctaagatgggctagtaaact

SEQ ID NO: 2833 - DNA, 47 bp, Homo Sapiens
  allele 24: 99-19283-172 : polymorphic base A or G
attcagataaacccctttgtccartagaagttgagcaatcattttca

SEQ ID NO: 2834 - DNA, 47 bp, Homo Sapiens
  allele 24: 99-19295-95 : polymorphic base C or T
ctacctctaccagagcaatgctaytggccttaggagaagatgaggtg

SEQ ID NO: 2835 - DNA, 47 bp, Homo Sapiens
  allele 24: 99-19304-270 : polymorphic base T or C
gcatccccaaggtgcccgtgcccygtgggccaagtcgctgacgttga

SEQ ID NO: 2836 - DNA, 47 bp, Homo Sapiens
  allele 24: 99-19305-367 : polymorphic base A or C
ctcggtcgactgggacccccacamgcagcacccccgcatgcagagcc

SEQ ID NO: 2837 - DNA, 47 bp, Homo Sapiens
  allele 24: 99-19309-296 : polymorphic base T or C
gggccaaggctctcaccttccccyggacaaggtttctaaggcccggg

SEQ ID NO: 2838 - DNA, 47 bp, Homo Sapiens
  allele 24: 99-19312-34 : polymorphic base G or A
ttagagtggttttaaaatttattrcaaatgacaaattgaaaaataag

SEQ ID NO: 2839 - DNA, 47 bp, Homo Sapiens
  allele 24: 99-19324-214 : polymorphic base A or G
gtcttggcaaagaaagaccctctrttggccaagacaggaatgagctg

SEQ ID NO: 2840 - DNA, 47 bp, Homo Sapiens
  allele 24: 99-19330-274 : polymorphic base G or T
ttttcactgtttcaggacacactkaatgcagttggagaggggaagcc

SEQ ID NO: 2841 - DNA, 47 bp, Homo Sapiens
  allele 24: 99-19347-228 : polymorphic base G or A
gcctgtcagacaaacttactctcrcctctcttctcggaggctagtcc

SEQ ID NO: 2842 - DNA, 47 bp, Homo Sapiens
  allele 24: 99-19348-229 : polymorphic base T or C
cattgcccccacatagaatctatyagcaagccctaccttccatattt

SEQ ID NO: 2843 - DNA, 47 bp, Homo Sapiens
  allele 24: 99-19351-360 : polymorphic base A or T
attctaccacagttgatgtactcwtctttggtcaatgacaggagagc

SEQ ID NO: 2844 - DNA, 47 bp, Homo Sapiens
  allele 24: 99-19368-92 : polymorphic base C or A
cataaaataatctggaaacagatmtgatcactgcctcatggggtgtg

SEQ ID NO: 2845 - DNA, 47 bp, Homo Sapiens
  allele 24: 99-19375-434 : polymorphic base G or A
aggtagttggggtaaaatgacaartaaggttttactggtgaatttcc

SEQ ID NO: 2846 - DNA, 47 bp, Homo Sapiens
  allele 24: 99-19381-249 : polymorphic base G or A
ttaggaatgagaaagatgacataratggaatcatgaaaggaatttta

SEQ ID NO: 2847 - DNA, 47 bp, Homo Sapiens
  allele 24: 99-19383-432 : polymorphic base G or C
gacagagctaggatttgaaaccasatgcaactacacagcccctcagt

SEQ ID NO: 2848 - DNA, 47 bp, Homo Sapiens
  allele 24: 99-19384-63 : polymorphic base G or A
cgtcaaaccaagtgagattgcacraggggctctcacttcctgtgctt

SEQ ID NO: 2849 - DNA, 47 bp, Homo Sapiens
  allele 24: 99-19418-61 : polymorphic base G or A
ggtaccatttcttaaagcagcagrttctaaaccttcctcgatcagac

SEQ ID NO: 2850 - DNA, 47 bp, Homo Sapiens
  allele 24: 99-19420-86 : polymorphic base A or T
attcaaagtaactgagacttgccwtttctcaagtgaaatttgaggca

SEQ ID NO: 2851 - DNA, 47 bp, Homo Sapiens
  allele 24: 99-19426-250 : polymorphic base G or A
atggagtattcttatataacactrtgttaaatggaactattttaatc

SEQ ID NO: 2852 - DNA, 47 bp, Homo Sapiens
  allele 24: 99-19431-249 : polymorphic base A or G
gcttattatagtcttagttgagarccaagcaattagtgcaactattc

SEQ ID NO: 2853 - DNA, 47 bp, Homo Sapiens
  allele 24: 99-19438-261 : polymorphic base T or A
gaaagatgtttttgtgatgatttwaaaaaaaaaaactgtattgaggc

SEQ ID NO: 2854 - DNA, 47 bp, Homo Sapiens
  allele 24: 99-19442-48 : polymorphic base G or A
attgttatcatcatttggtgatgrtcatcataactaataatgatttt

SEQ ID NO: 2855 - DNA, 47 bp, Homo Sapiens
  allele 24: 99-19444-350 : polymorphic base T or C
aaaagagtattttgataaaaaaaygaaagttaaatttggtaaattta

SEQ ID NO: 2856 - DNA, 47 bp, Homo Sapiens
  allele 24: 99-19450-440 : polymorphic base C or A
cttatcatgaacactggagagttmaatgcttctcactggagaacaca

SEQ ID NO: 2857 - DNA, 47 bp, Homo Sapiens
  allele 24: 99-19453-250 : polymorphic base G or T
ccaagatcatatagccagtaagtkagggtgctagtaagtaaaaattc

SEQ ID NO: 2858 - DNA, 47 bp, Homo Sapiens
  allele 24: 99-19457-182 : polymorphic base T or C
tcctgcaactttattgttttctgytggataaataatatttagtatct

SEQ ID NO: 2859 - DNA, 47 bp, Homo Sapiens
  allele 24: 99-19460-346 : polymorphic base G or T
catgcccagccctggcaggaaaakaaaggggtgggaggcagagaggc

SEQ ID NO: 2860 - DNA, 47 bp, Homo Sapiens
  allele 24: 99-19461-282 : polymorphic base T or C
atgaacatatttagaagatcactyggacagctgagtgaagaattaac

SEQ ID NO: 2861 - DNA, 47 bp, Homo Sapiens
  allele 24: 99-19464-165 : polymorphic base A or G
gcccctaaatcagtgttgaactcrgtatgtttaatttcaggatcagt

SEQ ID NO: 2862 - DNA, 47 bp, Homo Sapiens
  allele 24: 99-19466-406 : polymorphic base C or T
caatcattggacttttgtgaagtygacaccagctaaggctgcttaaa

SEQ ID NO: 2863 - DNA, 47 bp, Homo Sapiens
  allele 24: 99-19474-266 : polymorphic base G or T
ttatataaagcagctgtttttagkcattggacaacaagccagaagac

SEQ ID NO: 2864 - DNA, 47 bp, Homo Sapiens
  allele 24: 99-19475-113 : polymorphic base G or C
aattatggtctagtatagtaatastttcattttctgtctgaaaatgg

SEQ ID NO: 2865 - DNA, 47 bp, Homo Sapiens
  allele 24: 99-19477-208 : polymorphic base T or C
aattccaggtctctgaacacaaaygcaggaacctactccaaagatct

SEQ ID NO: 2866 - DNA, 47 bp, Homo Sapiens
  allele 24: 99-19504-468 : polymorphic base T or C
taactttttattgaagtataatayatgtagaaaaaagtgcactttta

SEQ ID NO: 2867 - DNA, 47 bp, Homo Sapiens
  allele 24: 99-19528-278 : polymorphic base C or T
taaagcaagatgagcatttaccaytgtatctgcagctcccaaaacaa

SEQ ID NO: 2868 - DNA, 47 bp, Homo Sapiens
  allele 24: 99-19529-118 : polymorphic base A or G
ccagactataaaagatccttgggrgctaagtcatttattataaaaca

SEQ ID NO: 2869 - DNA, 47 bp, Homo Sapiens
  allele 24: 99-19532-207 : polymorphic base G or T
cagtccatttagcaggccgatgakagattttcctggatgcctctcct

SEQ ID NO: 2870 - DNA, 47 bp, Homo Sapiens
  allele 24: 99-19538-272 : polymorphic base A or G
atataaaaaatgggcaaatttccraggaagaacaaagtgtggtaagt

SEQ ID NO: 2871 - DNA, 47 bp, Homo Sapiens
  allele 24: 99-19544-329 : polymorphic base G or A
tccatttctgtggatgaaaatcartgctgtacattatgacaaccatg

SEQ ID NO: 2872 - DNA, 47 bp, Homo Sapiens
  allele 24: 99-19546-473 : polymorphic base G or A
ggaccccaaaagatcatcatttcraagcacaattttttgttagtctc

SEQ ID NO: 2873 - DNA, 47 bp, Homo Sapiens
  allele 24: 99-19550-397 : polymorphic base G or T
attaaaaataaaatattgaaaatkcttaaaatatgtgtggtgaacaa

SEQ ID NO: 2874 - DNA, 47 bp, Homo Sapiens
  allele 24: 99-19553-52 : polymorphic base T or C
catcttattcagataagtgatacyggtagatttctttcaataagtac

SEQ ID NO: 2875 - DNA, 47 bp, Homo Sapiens
  allele 24: 99-19557-152 : polymorphic base A or G
tttgtacaaacatccttgcaaagraagtatggaacaagttagctgtt

SEQ ID NO: 2876 - DNA, 47 bp, Homo Sapiens
  allele 24: 99-19560-289 : polymorphic base G or T
agatttaccttttgagataaattkaggaaagattattgaaaatgttt

SEQ ID NO: 2877 - DNA, 47 bp, Homo Sapiens
  allele 24: 99-19562-227 : polymorphic base G or A
taacaatgactggaaatttctccraatcaatgttagaaaccaaccaa

SEQ ID NO: 2878 - DNA, 47 bp, Homo Sapiens
  allele 24: 99-19566-337 : polymorphic base C or G
tcatgatcaaaacacgatttaacsatttgaaggcaagacaactggct

SEQ ID NO: 2879 - DNA, 47 bp, Homo Sapiens
  allele 24: 99-19568-273 : polymorphic base C or T
ctgattttatctaatgatatcatytgatatcttcctctactccctga

SEQ ID NO: 2880 - DNA, 47 bp, Homo Sapiens
  allele 24: 99-19575-299 : polymorphic base A or G
tgctcgtcttttactaccaaaatrgatcttgagtacctaatttgtgt

SEQ ID NO: 2881 - DNA, 47 bp, Homo Sapiens
  allele 24: 99-19578-307 : polymorphic base A or G
ttacctgcttagaatttttaagaraactttaaagacatactttgaat

SEQ ID NO: 2882 - DNA, 47 bp, Homo Sapiens
  allele 24: 99-19580-323 : polymorphic base C or T
aaacttgttacaatatttaaagayagttcatctcacaatgttctttc

SEQ ID NO: 2883 - DNA, 47 bp, Homo Sapiens
  allele 24: 99-19584-352 : polymorphic base C or T
ccgtgatcctggtatagtccttgytctcttctaaaatacaccgctac

SEQ ID NO: 2884 - DNA, 47 bp, Homo Sapiens
  allele 24: 99-19588-438 : polymorphic base G or A
ctgtgcatttggcttaattaactrtctgagaaaacacattttacatt

SEQ ID NO: 2885 - DNA, 47 bp, Homo Sapiens
  allele 24: 99-19589-118 : polymorphic base C or T
gttcatggctgcattcccaatagytagcagagttcttagaacctaat

SEQ ID NO: 2886 - DNA, 47 bp, Homo Sapiens
  allele 24: 99-19601-95 : polymorphic base T or G
gagtcatttacaaataataaaagkcatctagacacacacatacatac

SEQ ID NO: 2887 - DNA, 47 bp, Homo Sapiens
  allele 24: 99-19624-48 : polymorphic base C or G
gtccctgaagggaagggagcaagsattttagccctcaccaggcttgg

SEQ ID NO: 2888 - DNA, 47 bp, Homo Sapiens
  allele 24: 99-19634-149 : polymorphic base A or G
catcactgctgaaattggtactgraaaagggaataatatctcttaga

SEQ ID NO: 2889 - DNA, 47 bp, Homo Sapiens
  allele 24: 99-19639-225 : polymorphic base A or G
tgctagcagagtaaaatgtttgcrtttgtctttctattttacttcat

SEQ ID NO: 2890 - DNA, 47 bp, Homo Sapiens
  allele 24: 99-19645-339 : polymorphic base A or G
ggatgaggtgcactgaatatattrgtgaatgagtgaagtacttccac

SEQ ID NO: 2891 - DNA, 47 bp, Homo Sapiens
  allele 24: 99-19650-338 : polymorphic base G or C
agaaaccagacagaccaactccasggtacactgtactgattattgtc

SEQ ID NO: 2892 - DNA, 47 bp, Homo Sapiens
  allele 24: 99-19651-133 : polymorphic base A or C
gatgggatgtgaggcaagcagttmcatccttttcgtaggctgacctg

SEQ ID NO: 2893 - DNA, 47 bp, Homo Sapiens
  allele 24: 99-19664-328 : polymorphic base G or A
attagaaaatattcacataatggratactctggtgtcttttaaaagg

SEQ ID NO: 2894 - DNA, 47 bp, Homo Sapiens
  allele 24: 99-19673-125 : polymorphic base C or G
cttccctgggacaggaagagatgsgaggaaggaggaacactggagaa

SEQ ID NO: 2895 - DNA, 47 bp, Homo Sapiens
  allele 24: 99-19678-269 : polymorphic base G or C
tgctttattctcccgacagcaagsaaaaatgtatcttcattaaatga

SEQ ID NO: 2896 - DNA, 47 bp, Homo Sapiens
  allele 24: 99-19685-39 : polymorphic base A or T
agcctgctagagactagtggttcwcatacctgatatgcaccagaatc

SEQ ID NO: 2897 - DNA, 47 bp, Homo Sapiens
  allele 24: 99-19697-304 : polymorphic base C or T
gctgttcaagttcacaggaattayaaagttagccagggaggcatctg

SEQ ID NO: 2898 - DNA, 47 bp, Homo Sapiens
  allele 24: 99-19703-75 : polymorphic base C or G
gcaacctggggatgggaactaagsatctctgattcaacatatagaaa

SEQ ID NO: 2899 - DNA, 47 bp, Homo Sapiens
  allele 24: 99-19705-128 : polymorphic base T or C
gaaataactctttagatagttaaytgggggaaaaaaaatcttatacc

SEQ ID NO: 2900 - DNA, 47 bp, Homo Sapiens
  allele 24: 99-19709-299 : polymorphic base T or G
aggttgtctagacagtagtttggktataaatatgaaagtaatgaaac

SEQ ID NO: 2901 - DNA, 47 bp, Homo Sapiens
  allele 24: 99-19711-169 : polymorphic base G or T
cactgaacccaaacagccctacckgctaatttcagtttgggctgctg

SEQ ID NO: 2902 - DNA, 47 bp, Homo Sapiens
  allele 24: 99-19722-150 : polymorphic base T or C
tatgccctatgcttgtgcctccayaaaatactgagccccatatctgt

SEQ ID NO: 2903 - DNA, 47 bp, Homo Sapiens
  allele 24: 99-19731-244 : polymorphic base A or G
caccctgatcagggtatggagagrgcatttgggcttacagaggtctg

SEQ ID NO: 2904 - DNA, 47 bp, Homo Sapiens
  allele 24: 99-19732-385 : polymorphic base T or A
tgccttccatatcttctcagactwttgagctcctgttcattgatcga

SEQ ID NO: 2905 - DNA, 47 bp, Homo Sapiens
  allele 24: 99-19736-62 : polymorphic base G or A
gatttaggtttagggaagtaagtrtacacacatatatgtatatgtat

SEQ ID NO: 2906 - DNA, 47 bp, Homo Sapiens
  allele 24: 99-19745-330 : polymorphic base C or T
gaccatcattggccaccggttctyttaaccgttcttttctataccta

SEQ ID NO: 2907 - DNA, 47 bp, Homo Sapiens
  allele 24: 99-19749-158 : polymorphic base G or A
tgatgatgaattttaaaacagcartgttttggcttgttaatatttaa

SEQ ID NO: 2908 - DNA, 47 bp, Homo Sapiens
  allele 24: 99-19752-88 : polymorphic base T or C
cctctcctggtttctcccccaccyaccttggttggcgctctgttcta

SEQ ID NO: 2909 - DNA, 47 bp, Homo Sapiens
  allele 24: 99-19753-300 : polymorphic base G or A
aagctaactgtgtcccttctggartcttagccccaaaggacagtagc

SEQ ID NO: 2910 - DNA, 47 bp, Homo Sapiens
  allele 24: 99-19756-85 : polymorphic base T or C
tggcgacagttgttcgttgtagayggaaagtcttttctgcattctga

SEQ ID NO: 2911 - DNA, 47 bp, Homo Sapiens
  allele 24: 99-19764-177 : polymorphic base T or C
acagagagcagtttcggttacaaygccagaggttacccttgctctga

SEQ ID NO: 2912 - DNA, 47 bp, Homo Sapiens
  allele 24: 99-19769-227 : polymorphic base C or T
gtttaccaagttcagcagtggcgyggaagaggctccgtgggctggtt

SEQ ID NO: 2913 - DNA, 47 bp, Homo Sapiens
  allele 24: 99-19780-179 : polymorphic base A or G
cctaactctcctgtcttcccctcrtggctgtcccctcccaggtagag

SEQ ID NO: 2914 - DNA, 47 bp, Homo Sapiens
  allele 24: 99-19785-140 : polymorphic base A or G
gacctccttagccaaaggcactgratgggttagtagtaagccgcagc

SEQ ID NO: 2915 - DNA, 47 bp, Homo Sapiens
  allele 24: 99-19790-398 : polymorphic base G or A
ttatttgggggattctaggcaacrtgaaacctctcagggccttattt

SEQ ID NO: 2916 - DNA, 47 bp, Homo Sapiens
  allele 24: 99-19791-103 : polymorphic base G or T
aaatacttttaaataattcaaaakatactgggaaagaataaccacag

SEQ ID NO: 2917 - DNA, 47 bp, Homo Sapiens
  allele 24: 99-19795-199 : polymorphic base A or G
gacagcatggaggggagtgtgggrggagaaggattgctactggcatc

SEQ ID NO: 2918 - DNA, 47 bp, Homo Sapiens
  allele 24: 99-19796-256 : polymorphic base T or G
catttctaataaggaagaccagtktgtagcacactaacccttccagc

SEQ ID NO: 2919 - DNA, 47 bp, Homo Sapiens
  allele 24: 99-19807-396 : polymorphic base C or T
agacaaacacaaacatacacaaaygcacaaaaaatcatgatgttagg

SEQ ID NO: 2920 - DNA, 47 bp, Homo Sapiens
  allele 24: 99-19813-55 : polymorphic base C or T
tttttttttagacaaagtaactaytgcttttaaaaatgatttcaaaa

SEQ ID NO: 2921 - DNA, 47 bp, Homo Sapiens
  allele 24: 99-19818-156 : polymorphic base C or T
tggtatttggtatgagaatgtctytgctttctattggtgacaaaagt

SEQ ID NO: 2922 - DNA, 47 bp, Homo Sapiens
  allele 24: 99-19826-285 : polymorphic base G or A
tctttgagtttcctagagtgctarcaactgtgttttgggaagagcct

SEQ ID NO: 2923 - DNA, 47 bp, Homo Sapiens
  allele 24: 99-19839-223 : polymorphic base A or G
atcctcaccaccagaaccacctcraacacctgggaaggcccctgatt

SEQ ID NO: 2924 - DNA, 47 bp, Homo Sapiens
  allele 24: 99-19851-40 : polymorphic base C or G
actgataagcatctggatactaasagaagagaggttaaaactgatgt

SEQ ID NO: 2925 - DNA, 47 bp, Homo Sapiens
  allele 24: 99-19858-91 : polymorphic base C or T
aaaaaataatttcaatagttaaaygtcagttcttaattaaccatctt

SEQ ID NO: 2926 - DNA, 47 bp, Homo Sapiens
  allele 24: 99-19860-68 : polymorphic base A or G
taatctgtttgggtggggtttctrtcacttgtggcctacagcagtct

SEQ ID NO: 2927 - DNA, 47 bp, Homo Sapiens
  allele 24: 99-19864-112 : polymorphic base T or C
ttttgtacgtttgaaatttttcayaataaaataccaaaaaaaattca

SEQ ID NO: 2928 - DNA, 47 bp, Homo Sapiens
  allele 24: 99-19871-422 : polymorphic base T or C
tagaaacaaaaaagagaacaaaayagacaggtcatttatggacctta

SEQ ID NO: 2929 - DNA, 47 bp, Homo Sapiens
  allele 24: 99-19872-136 : polymorphic base G or A
ttcttttgcatgcttttgattttrtggatcaataaaagaagactgaa

SEQ ID NO: 2930 - DNA, 47 bp, Homo Sapiens
  allele 24: 99-19875-99 : polymorphic base A or G
gccgtgagaaccatgttcagcacrtggaggagcggaacagagaagag

SEQ ID NO: 2931 - DNA, 47 bp, Homo Sapiens
  allele 24: 99-19876-394 : polymorphic base A or C
ttcctttttgcttggtcagttaamcctatttaccctcacttccttcc

SEQ ID NO: 2932 - DNA, 47 bp, Homo Sapiens
  allele 24: 99-19890-235 : polymorphic base A or C
aaactttctctgacaaagtactcmacaaattcagattacttaatgtc

SEQ ID NO: 2933 - DNA, 47 bp, Homo Sapiens
  allele 24: 99-19896-142 : polymorphic base G or T
caacttgctgatcaaacataaatktctactgttcacctttatgtgtt

SEQ ID NO: 2934 - DNA, 47 bp, Homo Sapiens
  allele 24: 99-19901-383 : polymorphic base C or T
catgtctttgtccaagtgttcttyttcattgcgaccttccctgacca

SEQ ID NO: 2935 - DNA, 47 bp, Homo Sapiens
  allele 24: 99-19906-136 : polymorphic base C or G
actgcgctggggaaatactggagsaacctcccactacgctagtgtta

SEQ ID NO: 2936 - DNA, 47 bp, Homo Sapiens
  allele 24: 99-19911-90 : polymorphic base G or C
atcaactctaagagaagattttasagttggaagatttgtaatagaat

SEQ ID NO: 2937 - DNA, 47 bp, Homo Sapiens
  allele 24: 99-19916-380 : polymorphic base T or C
atctcaagcaatgtatgtatcgaytgtatgtgtgtcaataaaacatg

SEQ ID NO: 2938 - DNA, 47 bp, Homo Sapiens
  allele 24: 99-19922-42 : polymorphic base G or A
ctgagctgagtcacagtgtaggcrcttaatgactacattcctaaata

SEQ ID NO: 2939 - DNA, 47 bp, Homo Sapiens
  allele 24: 99-19923-383 : polymorphic base G or A
tattatttcatgaagaaaaagttrattatataaggccttgctataca

SEQ ID NO: 2940 - DNA, 47 bp, Homo Sapiens
  allele 24: 99-19933-251 : polymorphic base A or G
taaggcttgctctaacccctgaartgggaggtccctctacctggctc

SEQ ID NO: 2941 - DNA, 47 bp, Homo Sapiens
  allele 24: 99-19937-235 : polymorphic base A or G
cctgattaaaatttctctattctrttgctttgtattttacctttcac

SEQ ID NO: 2942 - DNA, 47 bp, Homo Sapiens
  allele 24: 99-19944-306 : polymorphic base T or A
ttttgtgattatgtagaatatacwctctactctctggtctggcaaca

SEQ ID NO: 2943 - DNA, 47 bp, Homo Sapiens
  allele 24: 99-19951-313 : polymorphic base A or T
gcttttagaataacctgtcaaaawctcatctgattatagtattgcct

SEQ ID NO: 2944 - DNA, 47 bp, Homo Sapiens
  allele 24: 99-20038-204 : polymorphic base T or C
gcctgcaatcgtggagtgccagcytccccagggacacccagaaccca

SEQ ID NO: 2945 - DNA, 47 bp, Homo Sapiens
  allele 24: 99-20072-277 : polymorphic base A or T
cacagggaagagagacctcttttwatttttattttttgtggaggcaa

SEQ ID NO: 2946 - DNA, 47 bp, Homo Sapiens
  allele 24: 99-20226-32 : polymorphic base T or C
aagtcagtgagcaaatcgcggacyaccggggctgccagctcgcctga

SEQ ID NO: 2947 - DNA, 47 bp, Homo Sapiens
  allele 24: 99-20228-290 : polymorphic base T or C
tgttttcttttgaagacttatttyaaatattaactatttcggtgcct

SEQ ID NO: 2948 - DNA, 47 bp, Homo Sapiens
  allele 24: 99-20234-101 : polymorphic base C or G
gctgcactttggcccacttctttstacggaaagtcatcccatagccc

SEQ ID NO: 2949 - DNA, 47 bp, Homo Sapiens
  allele 24: 99-20537-433 : polymorphic base G or C
tctttttcttctttctttctttcsaatttttacccttctatctttct

SEQ ID NO: 2950 - DNA, 47 bp, Homo Sapiens
  allele 24: 99-20733-79 : polymorphic base G or A
ctgtttaaaagcatcacactgatrtcaggtccttcctctgagttttt

SEQ ID NO: 2951 - DNA, 47 bp, Homo Sapiens
  allele 24: 99-20815-363 : polymorphic base A or T
aaggactagatggtggattaaaawtttttttcttccagttattttct

SEQ ID NO: 2952 - DNA, 47 bp, Homo Sapiens
  allele 24: 99-20896-383 : polymorphic base A or G
gtgtacagaaatacagaagggttrcgagtatcagcaacttagatgcc

SEQ ID NO: 2953 - DNA, 47 bp, Homo Sapiens
  allele 24: 99-20958-373 : polymorphic base A or G
cactatgagctccttgtgggcagrgaccatgtgttatttacctctct

SEQ ID NO: 2954 - DNA, 47 bp, Homo Sapiens
  allele 24: 99-21057-337 : polymorphic base T or C
agacctgagcctccccaacaccaygcatgtaaccactggccaggcct

SEQ ID NO: 2955 - DNA, 47 bp, Homo Sapiens
  allele 24: 99-21059-118 : polymorphic base T or C
tgatgggtgtccggggtggtgggyaaaggcctgagaagaggtgggct

SEQ ID NO: 2956 - DNA, 47 bp, Homo Sapiens
  allele 24: 99-21110-304 : polymorphic base C or G
ctgttaatgttaataagaattgasagaagaaaaggagaggaaaagag

SEQ ID NO: 2957 - DNA, 47 bp, Homo Sapiens
  allele 24: 99-21123-62 : polymorphic base C or T
catatccaaaaactaactcgaaayaggccaggcatgttggctcacgc

SEQ ID NO: 2958 - DNA, 47 bp, Homo Sapiens
  allele 24: 99-21133-169 : polymorphic base G or A
acctactagaatattgcaatgtgrtatacataaagaataagtaagta

SEQ ID NO: 2959 - DNA, 47 bp, Homo Sapiens
  allele 24: 99-21181-413 : polymorphic base A or G
ctcggggcctgccggcactcatcrtctctgaaactcggcctctcacc

SEQ ID NO: 2960 - DNA, 47 bp, Homo Sapiens
  allele 24: 99-21192-164 : polymorphic base T or A
cagcctggccatccacctcatccwccctcatgtcacttaccacagag

SEQ ID NO: 2961 - DNA, 47 bp, Homo Sapiens
  allele 24: 99-21227-295 : polymorphic base T or C
agactgcgtccttcctatgggagygtcaggatgagctgcagtgtgcg

SEQ ID NO: 2962 - DNA, 47 bp, Homo Sapiens
  allele 24: 99-21229-81 : polymorphic base G or A
taataattatttctgttgtcacaragttctctttcattacttctggt

SEQ ID NO: 2963 - DNA, 47 bp, Homo Sapiens
  allele 24: 99-21240-419 : polymorphic base C or T
tggatcctgtctgccaggaatacyggagaaggaatttcggctcccag

SEQ ID NO: 2964 - DNA, 47 bp, Homo Sapiens
  allele 24: 99-21242-57 : polymorphic base T or A
ttctgaataactagaaagttacawgtatggaaatataaaagataggt

SEQ ID NO: 2965 - DNA, 47 bp, Homo Sapiens
  allele 24: 99-21244-495 : polymorphic base G or A
ctgaggctggagtgcagtggcgcratcctggagatggagacattttt

SEQ ID NO: 2966 - DNA, 47 bp, Homo Sapiens
  allele 24: 99-21252-77 : polymorphic base T or C
ctggcgtgcccctttataaactcytcctttccttcccactgcactta

SEQ ID NO: 2967 - DNA, 47 bp, Homo Sapiens
  allele 24: 99-21267-111 : polymorphic base C or T
agcgtttctcagcacaggagataygtaattttcaaacatgcaaaaaa

SEQ ID NO: 2968 - DNA, 47 bp, Homo Sapiens
  allele 24: 99-21284-322 : polymorphic base G or A
tctgcggtgagcacggtccatacrtacacacacagctggcgctgctc

SEQ ID NO: 2969 - DNA, 47 bp, Homo Sapiens
  allele 24: 99-21293-252 : polymorphic base A or G
catattttacaataatctcgaacractccaactatatgttgcagaag

SEQ ID NO: 2970 - DNA, 47 bp, Homo Sapiens
  allele 24: 99-21307-370 : polymorphic base A or G
agatattagggaaattctccagcrcctcctgttgccttttaataagc

SEQ ID NO: 2971 - DNA, 47 bp, Homo Sapiens
  allele 24: 99-21310-416 : polymorphic base A or G
gcttctctgatgctcttttcttcrtccagattcttctggctgttggg

SEQ ID NO: 2972 - DNA, 47 bp, Homo Sapiens
  allele 24: 99-21312-319 : polymorphic base C or A
gattgcatgtgtcagaaaaggatmttctttttcatttaggcctgata

SEQ ID NO: 2973 - DNA, 47 bp, Homo Sapiens
  allele 24: 99-21323-142 : polymorphic base A or G
aatagggagtaaacaggctgtgtrttattcctttgattggaacgtct

SEQ ID NO: 2974 - DNA, 47 bp, Homo Sapiens
  allele 24: 99-21327-94 : polymorphic base A or G
tttgacctgaaaaactaaatagarcatgaaagatgggaaaattctgt

SEQ ID NO: 2975 - DNA, 47 bp, Homo Sapiens
  allele 24: 99-21328-173 : polymorphic base C or T
acaagataagtttacggatactgytattatcaagttatcttagaaaa

SEQ ID NO: 2976 - DNA, 47 bp, Homo Sapiens
  allele 24: 99-21329-518 : polymorphic base A or G
atgaattacaccatttgtttaggrcactcttgggtatttatcaagga

SEQ ID NO: 2977 - DNA, 47 bp, Homo Sapiens
  allele 24: 99-21342-350 : polymorphic base T or C
aattgctcccttgctctctccacyacaaaatatttctactcattctt

SEQ ID NO: 2978 - DNA, 47 bp, Homo Sapiens
  allele 24: 99-21346-290 : polymorphic base G or A
gagactgagctgagcagtgtctcragccaccactttgtgaggccaag

SEQ ID NO: 2979 - DNA, 47 bp, Homo Sapiens
  allele 24: 99-21360-343 : polymorphic base A or G
tgggaatggcaagtgctcaaggtragcacgatgcagctgcgacctgt

SEQ ID NO: 2980 - DNA, 47 bp, Homo Sapiens
  allele 24: 99-21361-97 : polymorphic base G or T
gctggcttgtgtcagtacagggtkggccctccagggcagcgggcact

SEQ ID NO: 2981 - DNA, 47 bp, Homo Sapiens
  allele 24: 99-21377-73 : polymorphic base C or T
ttgcctgttggcctaccactgctyctggtattggaaatacatactgg

SEQ ID NO: 2982 - DNA, 47 bp, Homo Sapiens
  allele 24: 99-21378-303 : polymorphic base T or C
ggggtgaagaagcaccctcaatcyactacaaagccatggcaagagtg

SEQ ID NO: 2983 - DNA, 47 bp, Homo Sapiens
  allele 24: 99-21391-418 : polymorphic base G or A
agcacccaccatgagtcctcaagratttgggtgattcagtggcctgc

SEQ ID NO: 2984 - DNA, 47 bp, Homo Sapiens
  allele 24: 99-21401-117 : polymorphic base T or C
tgagaggtcgtggagtgtcacaaygtgacctgtgccgtgggacaagg

SEQ ID NO: 2985 - DNA, 47 bp, Homo Sapiens
  allele 24: 99-21423-302 : polymorphic base T or C
atgccacttattctaaaaaagaaygttacttttatattaatgtttca

SEQ ID NO: 2986 - DNA, 47 bp, Homo Sapiens
  allele 24: 99-21433-238 : polymorphic base T or G
gtagagccccacacagctgaggtktggggtcaaaaattaaaactaag

SEQ ID NO: 2987 - DNA, 47 bp, Homo Sapiens
  allele 24: 99-21441-420 : polymorphic base A or G
caggacctaagtgtctgttccctrttgattccccagtgccaggcatg

SEQ ID NO: 2988 - DNA, 47 bp, Homo Sapiens
  allele 24: 99-21444-227 : polymorphic base T or C
ccacctccccctggccacctacgycctggtcatctcagccaagaagg

SEQ ID NO: 2989 - DNA, 47 bp, Homo Sapiens
  allele 24: 99-21448-361 : polymorphic base A or G
aactgagccacatgtgccctctgrgcctggtcaccccaccacctgcc

SEQ ID NO: 2990 - DNA, 47 bp, Homo Sapiens
  allele 24: 99-21461-375 : polymorphic base C or T
taacttcctgctcctcattgcaaytgacttgttggtgatggctctgt

SEQ ID NO: 2991 - DNA, 47 bp, Homo Sapiens
  allele 24: 99-21463-258 : polymorphic base A or G
tgtgccactcttctttctgattcrgtacagtttagctacaatggttt

SEQ ID NO: 2992 - DNA, 47 bp, Homo Sapiens
  allele 24: 99-21465-58 : polymorphic base C or A
ataatcctaccaccctttgctgamtcttttcttggactcagcccgcc

SEQ ID NO: 2993 - DNA, 47 bp, Homo Sapiens
  allele 24: 99-21486-88 : polymorphic base C or A
aatatatcttctccacactcaggmctcaaaaaatacacaccaaagat

SEQ ID NO: 2994 - DNA, 47 bp, Homo Sapiens
  allele 24: 99-21492-310 : polymorphic base C or T
cctctgctgaatgccaaggctgcycttgatcccctccaacccccaca

SEQ ID NO: 2995 - DNA, 47 bp, Homo Sapiens
  allele 24: 99-21502-211 : polymorphic base G or A
acagatgagaaaactgggcctcargtgacttgcccaagtgagcagga

SEQ ID NO: 2996 - DNA, 47 bp, Homo Sapiens
  allele 24: 99-21508-131 : polymorphic base C or A
gaacctaagcggaggagcagcccmccagctctggagcgagtttggcc

SEQ ID NO: 2997 - DNA, 47 bp, Homo Sapiens
  allele 24: 99-21510-466 : polymorphic base T or A
gttccaactgaactgcggggaccwaatgtgagaagggtggttcctga

SEQ ID NO: 2998 - DNA, 47 bp, Homo Sapiens
  allele 24: 99-21512-165 : polymorphic base A or T
aaactgtaggatgaatatcctctwctttcgatctatttggtatccct

SEQ ID NO: 2999 - DNA, 47 bp, Homo Sapiens
  allele 24: 99-21516-293 : polymorphic base G or T
tccgcctgcctcagcctcccaaaktgctaggattataggcgtgagcc

SEQ ID NO: 3000 - DNA, 47 bp, Homo Sapiens
  allele 24: 99-21533-445 : polymorphic base C or T
tccttctgcagcatctatgtcctytgtgccttcctttacttcagcac

SEQ ID NO: 3001 - DNA, 47 bp, Homo Sapiens
  allele 24: 99-21560-376 : polymorphic base G or A
tagaatactttaaaggtttcaccraaagagttctaagcctggaaaaa

SEQ ID NO: 3002 - DNA, 47 bp, Homo Sapiens
  allele 24: 99-21561-41 : polymorphic base T or C
agatatcaatttcccctgtgtgaytcagagcgaatactaaaaatgga

SEQ ID NO: 3003 - DNA, 47 bp, Homo Sapiens
  allele 24: 99-21566-152 : polymorphic base C or T
gtgcacagcccagagatacatcayagtgtctactataggcaaagccc

SEQ ID NO: 3004 - DNA, 47 bp, Homo Sapiens
  allele 24: 99-21578-105 : polymorphic base T or C
ctctcctccagctcttcccagggyccctctgcattctggaaggctgg

SEQ ID NO: 3005 - DNA, 47 bp, Homo Sapiens
  allele 24: 99-21580-141 : polymorphic base A or G
ctacagcggctcctttgtcataarttatgagatggtgtgtttttgtt

SEQ ID NO: 3006 - DNA, 47 bp, Homo Sapiens
  allele 24: 99-21591-181 : polymorphic base T or G
acatgatagcagacacaaaacggkgtggggtttccttcttatataga

SEQ ID NO: 3007 - DNA, 47 bp, Homo Sapiens
  allele 24: 99-21592-43 : polymorphic base C or T
ctgtccagtctgccagtggtatgycctggtgtgtttctttgtactgt

SEQ ID NO: 3008 - DNA, 47 bp, Homo Sapiens
  allele 24: 99-21607-114 : polymorphic base A or G
actcctccgcctcacccagtttcrtgcattacagatttgcatgcatg

SEQ ID NO: 3009 - DNA, 47 bp, Homo Sapiens
  allele 24: 99-21615-133 : polymorphic base C or T
agaggctgaaagtgacctctgggygtctataattaggccctgcctga

SEQ ID NO: 3010 - DNA, 47 bp, Homo Sapiens
  allele 24: 99-21657-161 : polymorphic base T or C
taattttatttacataaagcactyagtagagtagcacatggtaagtg

SEQ ID NO: 3011 - DNA, 47 bp, Homo Sapiens
  allele 24: 99-21664-278 : polymorphic base G or T
gagtctcggagcccacacccacckcccgagtccccgaggcagggcag

SEQ ID NO: 3012 - DNA, 47 bp, Homo Sapiens
  allele 24: 99-21666-96 : polymorphic base C or A
gtgccagaaatttctggggtgccmcttgtgcttccttagaggtccct

SEQ ID NO: 3013 - DNA, 47 bp, Homo Sapiens
  allele 24: 99-21673-106 : polymorphic base A or T
attttttcaaatgtctgagcatcwcccttaaatgggatatgaacaag

SEQ ID NO: 3014 - DNA, 47 bp, Homo Sapiens
  allele 24: 99-21674-245 : polymorphic base G or C
aaaaaaagtgtcacctagttccasaaaatagaggcaatggactcaga

SEQ ID NO: 3015 - DNA, 47 bp, Homo Sapiens
  allele 24: 99-21687-313 : polymorphic base G or A
tcttagtctctggaaagatgaagrctgtgattctgaacaaggaaagc

SEQ ID NO: 3016 - DNA, 47 bp, Homo Sapiens
  allele 24: 99-21690-162 : polymorphic base A or G
ctgtggggctttcttttgagactrgaaagcccatgagataagtggtt

SEQ ID NO: 3017 - DNA, 47 bp, Homo Sapiens
  allele 24: 99-21693-368 : polymorphic base C or T
tgagattctggaatctgtgatgaygcaaactagcccttgaagaggtg

SEQ ID NO: 3018 - DNA, 47 bp, Homo Sapiens
  allele 24: 99-21699-149 : polymorphic base G or C
ttcatgaggagtacagaatttatsctgagacagcactgggggatttt

SEQ ID NO: 3019 - DNA, 47 bp, Homo Sapiens
  allele 24: 99-21703-36 : polymorphic base G or A
tctatggsctcagtctatcactcragcagaaaccaccaacacccaca

SEQ ID NO: 3020 - DNA, 47 bp, Homo Sapiens
  allele 24: 99-21705-306 : polymorphic base T or G
gtgcctactaaggtggccacggckcattgctggagctgtgccccatg

SEQ ID NO: 3021 - DNA, 47 bp, Homo Sapiens
  allele 24: 99-21707-429 : polymorphic base C or T
ttctgacttctatttggaatccaygaagatccctaggccaacacttc

SEQ ID NO: 3022 - DNA, 47 bp, Homo Sapiens
  allele 24: 99-21710-272 : polymorphic base C or G
taatactgggcatcttcttatgtsctattggccacttgtattttcct

SEQ ID NO: 3023 - DNA, 47 bp, Homo Sapiens
  allele 24: 99-21733-323 : polymorphic base G or C
agtattgtctctccacatttattstatttaactatagtattaggagt

SEQ ID NO: 3024 - DNA, 47 bp, Homo Sapiens
  allele 24: 99-21734-183 : polymorphic base C or T
agaccactgagagcatttaacgcyctggacttctgacatccacaata

SEQ ID NO: 3025 - DNA, 47 bp, Homo Sapiens
  allele 24: 99-21742-337 : polymorphic base G or A
gttatctccttcagtgctagctgrgggttaattttttcctcatacat

SEQ ID NO: 3026 - DNA, 47 bp, Homo Sapiens
  allele 24: 99-21745-455 : polymorphic base T or C
acataccctttctacaagaagtaygtaaatatctgataaaggtcatt

SEQ ID NO: 3027 - DNA, 47 bp, Homo Sapiens
  allele 24: 99-21756-230 : polymorphic base T or G
tgcgtggtgctggttggaatactkttctaatgaagtcaccatctggg

SEQ ID NO: 3028 - DNA, 44 bp, Homo Sapiens
  allele 21: 99-21759-21 : polymorphic base T or G
aacttctgctcggatttgcckatgtcatgtccactcacatgcta

SEQ ID NO: 3029 - DNA, 47 bp, Homo Sapiens
  allele 24: 99-21762-135 : polymorphic base A or C
gggtaatggatgacaaatgtgaamttttcaaaagttatttaattttt

SEQ ID NO: 3030 - DNA, 47 bp, Homo Sapiens
  allele 24: 99-21763-52 : polymorphic base A or G
tctcttgtttcagcaaactattcrgcagcagatagcactgcccatac

SEQ ID NO: 3031 - DNA, 47 bp, Homo Sapiens
  allele 24: 99-21765-111 : polymorphic base A or T
agccttcagtgtctaccattcaawttttcacaagttacaaaactcag

SEQ ID NO: 3032 - DNA, 47 bp, Homo Sapiens
  allele 24: 99-21767-392 : polymorphic base T or A
ataaatatgcatttacgtagagcwtcctcctagctgtagagtgctga

SEQ ID NO: 3033 - DNA, 47 bp, Homo Sapiens
  allele 24: 99-21771-144 : polymorphic base G or A
ttaagggcaccccgactgaacatrtgtagactccagtctctacacca

SEQ ID NO: 3034 - DNA, 47 bp, Homo Sapiens
  allele 24: 99-21775-466 : polymorphic base A or T
aatagacacaagaaaaaagagggwcctacagtattgagagaatacgc

SEQ ID NO: 3035 - DNA, 47 bp, Homo Sapiens
  allele 24: 99-21787-348 : polymorphic base A or G
gtgatgaggccatgaaggggagtratggggactgtgtgatttttcaa

SEQ ID NO: 3036 - DNA, 47 bp, Homo Sapiens
  allele 24: 99-21790-161 : polymorphic base G or A
aaatgcagtcatagaagggctacrtaggctgagactcaggattagca

SEQ ID NO: 3037 - DNA, 47 bp, Homo Sapiens
  allele 24: 99-21791-364 : polymorphic base T or C
gagtagcaggctggtgttaagacytcagatcccagcctcagggccag

SEQ ID NO: 3038 - DNA, 47 bp, Homo Sapiens
  allele 24: 99-21800-310 : polymorphic base A or G
tttagaacagtttcaaattcacarcaacattgtgaagaaagtacagt

SEQ ID NO: 3039 - DNA, 47 bp, Homo Sapiens
  allele 24: 99-21801-123 : polymorphic base T or C
gtggagaaaagacttcaatttgtyacagaatagagcctgtgactcac

SEQ ID NO: 3040 - DNA, 47 bp, Homo Sapiens
  allele 24: 99-21804-310 : polymorphic base T or C
acaatggcatagtttgctgcacayccatagcagtgccttattaaaaa

SEQ ID NO: 3041 - DNA, 47 bp, Homo Sapiens
  allele 24: 99-21810-222 : polymorphic base G or A
aaaaggaattatagaattaaattrtgaaatgtgctccaaggaaatac

SEQ ID NO: 3042 - DNA, 47 bp, Homo Sapiens
  allele 24: 99-21811-209 : polymorphic base T or C
ctggaacacaagtctgcatcggtytttgcacgtggtgttgctgctgc

SEQ ID NO: 3043 - DNA, 47 bp, Homo Sapiens
  allele 24: 99-21827-155 : polymorphic base T or C
gggaaatttataattttacttgcygcctccagagtttcccttggctt

SEQ ID NO: 3044 - DNA, 47 bp, Homo Sapiens
  allele 24: 99-21829-261 : polymorphic base C or T
gggagggaggagagccagtttgtyctcagccgggtgggctggtgccc

SEQ ID NO: 3045 - DNA, 47 bp, Homo Sapiens
  allele 24: 99-21831-311 : polymorphic base A or G
cagcacttgtgactctgtcctcarcatttgccaaaggagcatctcct

SEQ ID NO: 3046 - DNA, 47 bp, Homo Sapiens
  allele 24: 99-21838-153 : polymorphic base A or G
agagggggccaggcagacccagcrtcaggcaatctgaacagggcagt

SEQ ID NO: 3047 - DNA, 47 bp, Homo Sapiens
  allele 24: 99-21844-165 : polymorphic base G or A
gcactaacttctatagaaaccagrggttttgaaacaagtcacagtgc

SEQ ID NO: 3048 - DNA, 47 bp, Homo Sapiens
  allele 24: 99-21846-327 : polymorphic base C or T
ctcaggtggccctgtccccagcaygtggcaggcctgtgtatgctaaa

SEQ ID NO: 3049 - DNA, 47 bp, Homo Sapiens
  allele 24: 99-21874-311 : polymorphic base G or T
ccagttccccacagatcaaaacckccgggctccgcacagccctgagc

SEQ ID NO: 3050 - DNA, 47 bp, Homo Sapiens
  allele 24: 99-21880-331 : polymorphic base C or T
agactgcaaatcccactttaactytcatcagctgcatgttattgtgc

SEQ ID NO: 3051 - DNA, 47 bp, Homo Sapiens
  allele 24: 99-21881-152 : polymorphic base T or C
tccacttgcagctttaggaactaygttccttttctgctragaaaatt

SEQ ID NO: 3052 - DNA, 47 bp, Homo Sapiens
  allele 24: 99-21889-219 : polymorphic base G or A
aacaactttcttgctctccagtarttaaacatctctcattcagcatc

SEQ ID NO: 3053 - DNA, 47 bp, Homo Sapiens
  allele 24: 99-21893-388 : polymorphic base G or A
ccaagaagttcaatgaacaccaaraagaagaagaagaagaagaagaa

SEQ ID NO: 3054 - DNA, 47 bp, Homo Sapiens
  allele 24: 99-21896-345 : polymorphic base A or G
gttgaatagttgtgacagacacaragaattgtggttcacaagcctgt

SEQ ID NO: 3055 - DNA, 47 bp, Homo Sapiens
  allele 24: 99-21898-102 : polymorphic base T or A
attttgataagctcttcacttgawtgttatagacaggacattaatgg

SEQ ID NO: 3056 - DNA, 47 bp, Homo Sapiens
  allele 24: 99-21901-331 : polymorphic base G or A
agtattgatgatattaatagctaraacagacacagtgccatacccac

SEQ ID NO: 3057 - DNA, 47 bp, Homo Sapiens
  allele 24: 99-21913-483 : polymorphic base A or G
ttttctacctcaaaacgttgttartagtattccagtgtcctctggaa

SEQ ID NO: 3058 - DNA, 47 bp, Homo Sapiens
  allele 24: 99-21916-359 : polymorphic base A or G
gggaaacaaccttgccaactacgrtgcagtgccttatggctcctggt

SEQ ID NO: 3059 - DNA, 47 bp, Homo Sapiens
  allele 24: 99-21917-84 : polymorphic base G or C
tgttctgtcacatagactagtacstgttccttccaaacatgtaacct

SEQ ID NO: 3060 - DNA, 47 bp, Homo Sapiens
  allele 24: 99-21919-38 : polymorphic base A or G
tatcctgtatttcaccatttattrgctctgtgacccttaagtaagtg

SEQ ID NO: 3061 - DNA, 47 bp, Homo Sapiens
  allele 24: 99-21921-338 : polymorphic base T or C
taagctaggatgtgaatctagacyatcctgaccccgtcatctatata

SEQ ID NO: 3062 - DNA, 47 bp, Homo Sapiens
  allele 24: 99-21943-413 : polymorphic base C or T
tggttgtaatcatccagttgtggygctcacttcaccctggggcactg

SEQ ID NO: 3063 - DNA, 47 bp, Homo Sapiens
  allele 24: 99-21948-237 : polymorphic base C or T
acctctgaaaagctacacaggcayaaagagtaaggaatagtttctca

SEQ ID NO: 3064 - DNA, 47 bp, Homo Sapiens
  allele 24: 99-21950-107 : polymorphic base G or C
tttacagtcgtgaaaaagcgttgsggggagcgggaggaggaaacgaa

SEQ ID NO: 3065 - DNA, 47 bp, Homo Sapiens
  allele 24: 99-21952-76 : polymorphic base T or C
tagtastcattcaaagaaaggacyccaaaagcctggtcacacacaca

SEQ ID NO: 3066 - DNA, 47 bp, Homo Sapiens
  allele 24: 99-21968-150 : polymorphic base G or A
ccttaggggttccattcaaactaraaaagtggtttatctgattcccc

SEQ ID NO: 3067 - DNA, 47 bp, Homo Sapiens
  allele 24: 99-21969-425 : polymorphic base T or G
aaatgaacttcctgtaaatagatktcagtgttttgacagtacactgt

SEQ ID NO: 3068 - DNA, 47 bp, Homo Sapiens
  allele 24: 99-22008-325 : polymorphic base C or T
gattccagccctgagaaatcaaayaagaagactagaatttggatgag

SEQ ID NO: 3069 - DNA, 47 bp, Homo Sapiens
  allele 24: 99-22098-101 : polymorphic base C or G
taacatctttcccactcaactttsaaaacaacaggaagtagaagaaa

SEQ ID NO: 3070 - DNA, 47 bp, Homo Sapiens
  allele 24: 99-22155-199 : polymorphic base T or C
acaagcagggaatatgtgattggyacatgaaaggcacatgcagaatt

SEQ ID NO: 3071 - DNA, 47 bp, Homo Sapiens
  allele 24: 99-22181-171 : polymorphic base G or A
aagtaattgtctttcaattgttcrtgaatattaataattctcctttt

SEQ ID NO: 3072 - DNA, 47 bp, Homo Sapiens
  allele 24: 99-22187-261 : polymorphic base C or T
taatctctgtcctctgtgatagcytgcagaaatatagtttagtttaa

SEQ ID NO: 3073 - DNA, 47 bp, Homo Sapiens
  allele 24: 99-22190-369 : polymorphic base T or C
attttaaaaacagaatcccttctygccttacttacttggtactttaa

SEQ ID NO: 3074 - DNA, 47 bp, Homo Sapiens
  allele 24: 99-22202-58 : polymorphic base T or C
tttcagtaattagggacccatgcytttctctccatatttcatttcct

SEQ ID NO: 3075 - DNA, 47 bp, Homo Sapiens; identical to SEQ ID NO: 3074
  allele 24: 99-22204-391 : polymorphic base T or C

SEQ ID NO: 3076 - DNA, 47 bp, Homo Sapiens
  allele 24: 99-22206-455 : polymorphic base C or G
tttccctgattcctggtaagattsatcattatttcatgtttatcaac

SEQ ID NO: 3077 - DNA, 47 bp, Homo Sapiens
  allele 24: 99-22213-333 : polymorphic base T or A
actagttgctaagtcatctgattwtttttcttacacataatacacaa

SEQ ID NO: 3078 - DNA, 47 bp, Homo Sapiens
  allele 24: 99-22355-213 : polymorphic base T or A
ggtctcctctagccctttcctagwtgtccaccaattggagaagaagc

SEQ ID NO: 3079 - DNA, 47 bp, Homo Sapiens
  allele 24: 99-22363-268 : polymorphic base A or G
agtaagcctagcgaagactgaaaragaaggcaaagggtttggtacag

SEQ ID NO: 3080 - DNA, 47 bp, Homo Sapiens
  allele 24: 99-22375-353 : polymorphic base G or A
tcaatatcgttttctcatatcttrctttagaattttgtacaacttat

SEQ ID NO: 3081 - DNA, 47 bp, Homo Sapiens
  allele 24: 99-22405-335 : polymorphic base C or T
gatggctgttccagaagattccayataggtcgggctccctagaagct

SEQ ID NO: 3082 - DNA, 47 bp, Homo Sapiens
  allele 24: 99-2251-151 : polymorphic base G or A
tgaaaagaagttcagacgattgcrgatagactagtttggctgttgtg

SEQ ID NO: 3083 - DNA, 47 bp, Homo Sapiens
  allele 24: 99-22530-48 : polymorphic base C or T
atgtttgaaaaagccaaaaaggayactatcgttttatagggacagat

SEQ ID NO: 3084 - DNA, 47 bp, Homo Sapiens
  allele 24: 99-22537-280 : polymorphic base A or G
tctatttcattccttccacagtcrgttatttttcttatacctcccaa

SEQ ID NO: 3085 - DNA, 47 bp, Homo Sapiens
  allele 24: 99-22567-243 : polymorphic base C or G
gataaagctagagggagtggcctstaacaaacatacaacggatccca

SEQ ID NO: 3086 - DNA, 47 bp, Homo Sapiens
  allele 24: 99-22572-72 : polymorphic base A or G
ttttaatctgtacccaacaaagcrtttgcaatgggagttctgcaata

SEQ ID NO: 3087 - DNA, 47 bp, Homo Sapiens
  allele 24: 99-22593-64 : polymorphic base C or T
gcttgtgtatcttttataagctcytaaggaaataagcatatcaaaag

SEQ ID NO: 3088 - DNA, 47 bp, Homo Sapiens
  allele 24: 99-22706-367 : polymorphic base T or C
catgagagtaagaatgcccacttygcagtgttatgatgaggaccatc

SEQ ID NO: 3089 - DNA, 47 bp, Homo Sapiens
  allele 24: 99-22729-352 : polymorphic base T or A
ctggggaaccagagactgtggcawgaggctcttctgtttcttctggc

SEQ ID NO: 3090 - DNA, 47 bp, Homo Sapiens
  allele 24: 99-22768-113 : polymorphic base G or T
ctttgatccctcaaactttgttckcccttctcttgccacagctgaga

SEQ ID NO: 3091 - DNA, 47 bp, Homo Sapiens
  allele 24: 99-22814-349 : polymorphic base C or T
cctgcggcgcacaatgacttgagygaggctctcttctttgcctcaat

SEQ ID NO: 3092 - DNA, 47 bp, Homo Sapiens
  allele 24: 99-22818-33 : polymorphic base C or T
gtcaataggtagatgttcttaatyatttattattataaattatggta

SEQ ID NO: 3093 - DNA, 47 bp, Homo Sapiens
  allele 24: 99-22826-311 : polymorphic base C or T
ctgaatctggtacatgtgatcccyaggttgccagccttaaatatgta

SEQ ID NO: 3094 - DNA, 47 bp, Homo Sapiens
  allele 24: 99-22851-121 : polymorphic base A or G
tgtttgatggcagaagagcttagratttctttaaggtcttgggccag

SEQ ID NO: 3095 - DNA, 47 bp, Homo Sapiens
  allele 24: 99-23113-388 : polymorphic base C or T
tgattagaactgggttatgctttyttggccaaaatagcacagaagtg

SEQ ID NO: 3096 - DNA, 47 bp, Homo Sapiens
  allele 24: 99-23188-227 : polymorphic base T or C
cctctcttaaagggagctaaaaayacctaattctcagtgagcaaacg

SEQ ID NO: 3097 - DNA, 47 bp, Homo Sapiens
  allele 24: 99-23240-326 : polymorphic base C or A
cagaactccaagggactgggagamggcataaagtcctgaaacttctc

SEQ ID NO: 3098 - DNA, 47 bp, Homo Sapiens
  allele 24: 99-23246-66 : polymorphic base A or G
agtcatgatgtttgctatgaaaaragcccttatctatgttctggttt

SEQ ID NO: 3099 - DNA, 47 bp, Homo Sapiens
  allele 24: 99-23248-308 : polymorphic base A or G
gatgaaaaatactgtactttctargcaatattaacataagtaaagtt

SEQ ID NO: 3100 - DNA, 47 bp, Homo Sapiens
  allele 24: 99-23249-262 : polymorphic base A or G
aactcatgctgcagtagcatcacrgtcccacggttgtgtgttggctg

SEQ ID NO: 3101 - DNA, 47 bp, Homo Sapiens
  allele 24: 99-23274-182 : polymorphic base C or T
tgactggagcaaaaccaaagatgyaataaataattaatggaggtagg

SEQ ID NO: 3102 - DNA, 47 bp, Homo Sapiens
  allele 24: 99-2333-423 : polymorphic base T or G
gagacgctatctatgcaaggaggktgttcaacatttggacagccacg

SEQ ID NO: 3103 - DNA, 47 bp, Homo Sapiens
  allele 24: 99-2341-485 : polymorphic base C or T
acacatctgtctgttacctacacyttacaaagaatcgcacaggctct

SEQ ID NO: 3104 - DNA, 47 bp, Homo Sapiens
  allele 24: 99-2342-217 : polymorphic base C or T
tagagccttggactttcatgacayttctagaaacagcccagattgtg

SEQ ID NO: 3105 - DNA, 47 bp, Homo Sapiens
  allele 24: 99-23427-283 : polymorphic base G or A
cagccagcacccagaatgtgcagrtcactgtcctgggctggggagaa

SEQ ID NO: 3106 - DNA, 47 bp, Homo Sapiens
  allele 24: 99-23442-190 : polymorphic base T or C
ttttaaaaattaggcacctcaaayatctactgcttttgagcttttga

SEQ ID NO: 3107 - DNA, 47 bp, Homo Sapiens
  allele 24: 99-23544-340 : polymorphic base C or A
gacccgatctagatcacaaagggmtcccctgaagcagtgacagctaa

SEQ ID NO: 3108 - DNA, 47 bp, Homo Sapiens
  allele 24: 99-23549-78 : polymorphic base G or A
tgagattaactatgcttagctccraagtcaaaattaggtaaaagatg

SEQ ID NO: 3109 - DNA, 47 bp, Homo Sapiens
  allele 24: 99-23558-98 : polymorphic base A or G
agcaataactattacatactgacrtgtccccacgggctgaggaggaa

SEQ ID NO: 3110 - DNA, 47 bp, Homo Sapiens
  allele 24: 99-23565-252 : polymorphic base G or C
cctctgagctactctatttaccasaagcaagcattttccctctgccc

SEQ ID NO: 3111 - DNA, 47 bp, Homo Sapiens
  allele 24: 99-23589-198 : polymorphic base A or C
ctcaccccctcggctggtttcctmctctgcaccctgtcctccagatg

SEQ ID NO: 3112 - DNA, 47 bp, Homo Sapiens
  allele 24: 99-23590-205 : polymorphic base C or T
agctccttaagcctcaggcttctygaagctctgtgccctcctgtgca

SEQ ID NO: 3113 - DNA, 47 bp, Homo Sapiens
  allele 24: 99-23621-189 : polymorphic base G or A
cccctggatctgcttttattgttrttctttttgttttggaaatgggg

SEQ ID NO: 3114 - DNA, 47 bp, Homo Sapiens
  allele 24: 99-23641-159 : polymorphic base G or A
ttctctaacttggactacgggacrgggagtgggggctacactacact

SEQ ID NO: 3115 - DNA, 47 bp, Homo Sapiens
  allele 24: 99-23652-244 : polymorphic base G or A
ggaacgcagtgtgttgtgactttrttaaagtcaaaacacctgccatc

SEQ ID NO: 3116 - DNA, 47 bp, Homo Sapiens
  allele 24: 99-23696-164 : polymorphic base C or T
ttctccatccacccctcactcctyccctcagctaaagcccacctttc

SEQ ID NO: 3117 - DNA, 47 bp, Homo Sapiens
  allele 24: 99-23701-104 : polymorphic base C or T
acaatctcaggggaaaaagtgggygcaggtgcggaaaggcgctgcac

SEQ ID NO: 3118 - DNA, 47 bp, Homo Sapiens
  allele 24: 99-23702-437 : polymorphic base G or A
gcaccatgtgaccattttcagaarggaagacagttctggaagctaaa

SEQ ID NO: 3119 - DNA, 47 bp, Homo Sapiens
  allele 24: 99-2371-93 : polymorphic base A or C
ctctaaactttcctaatacttacmtcactgcctactttttacataat

SEQ ID NO: 3120 - DNA, 47 bp, Homo Sapiens
  allele 24: 99-23711-455 : polymorphic base C or T
taaacattctagactttcattacytgtaactctctgaagtttgaatg

SEQ ID NO: 3121 - DNA, 47 bp, Homo Sapiens
  allele 24: 99-23730-202 : polymorphic base T or C
actgtttaaatggagggccccctyagggcatttcagtatttgtttat

SEQ ID NO: 3122 - DNA, 47 bp, Homo Sapiens
  allele 24: 99-23736-314 : polymorphic base G or A
agaggttttcatactatagacaargcgggtataaatgttaattcgag

SEQ ID NO: 3123 - DNA, 47 bp, Homo Sapiens
  allele 24: 99-23813-476 : polymorphic base C or T
ggattactgagaaatctcactgtygtgctgtgaccacaacgtacaca

SEQ ID NO: 3124 - DNA, 47 bp, Homo Sapiens
  allele 24: 99-23821-176 : polymorphic base G or C
acatcctgccctcgggctcaacgstccctgcatctctacatccctgg

SEQ ID NO: 3125 - DNA, 47 bp, Homo Sapiens
  allele 24: 99-23844-382 : polymorphic base A or C
acagtctctcttcagagggcaacmagatgttcatgcttttaattaca

SEQ ID NO: 3126 - DNA, 47 bp, Homo Sapiens
  allele 24: 99-23858-51 : polymorphic base G or T
aatttgtttcacctgaaattgcckcagcatttatgcacattatttcc

SEQ ID NO: 3127 - DNA, 47 bp, Homo Sapiens
  allele 24: 99-23860-146 : polymorphic base G or C
ggcactgtaggggtggctgcttcscttaccctgagggtctctgggtc

SEQ ID NO: 3128 - DNA, 47 bp, Homo Sapiens
  allele 24: 99-23876-265 : polymorphic base A or C
ttgatttctatatttttaaaagtmttttaactatttccaacaattca

SEQ ID NO: 3129 - DNA, 47 bp, Homo Sapiens
  allele 24: 99-23878-400 : polymorphic base C or A
atcttcctactatagtgtgagctmttggagggtgcagaccaagtctt

SEQ ID NO: 3130 - DNA, 47 bp, Homo Sapiens
  allele 24: 99-23880-268 : polymorphic base G or A
cccaatgctagcacagtgccatcrtgctaggctggttttatgtagtg

SEQ ID NO: 3131 - DNA, 47 bp, Homo Sapiens
  allele 24: 99-23887-103 : polymorphic base G or A
ggaccccacccacccctccatggrctgggtcccagctgtgtacatac

SEQ ID NO: 3132 - DNA, 47 bp, Homo Sapiens
  allele 24: 99-23889-342 : polymorphic base A or G
tacttccctcttaggcttctaatragtttattttgctatgtgcttag

SEQ ID NO: 3133 - DNA, 47 bp, Homo Sapiens
  allele 24: 99-23894-339 : polymorphic base T or C
gtatgatgttctgccttgactacygtggttccatttttctccctaag

SEQ ID NO: 3134 - DNA, 47 bp, Homo Sapiens
  allele 24: 99-23895-40 : polymorphic base T or C
tggtgtgaatctcagtccatacaygctgatgtcaaaaattagaacta

SEQ ID NO: 3135 - DNA, 47 bp, Homo Sapiens
  allele 24: 99-23902-103 : polymorphic base T or C
ggagagagttgccaggctgcaggyactgctgactcagctggaagcaa

SEQ ID NO: 3136 - DNA, 47 bp, Homo Sapiens
  allele 24: 99-23912-116 : polymorphic base G or C
ttagtgcatggagggagaggggasccagtgtcaagcattgatccatt

SEQ ID NO: 3137 - DNA, 47 bp, Homo Sapiens
  allele 24: 99-23915-69 : polymorphic base A or G
acaacaggacccaggagtataccrggattgtttttcaaagggcatag

SEQ ID NO: 3138 - DNA, 47 bp, Homo Sapiens
  allele 24: 99-23918-179 : polymorphic base T or C
accagtttgactgcctgagactcyagacccacattcttgccagttgt

SEQ ID NO: 3139 - DNA, 47 bp, Homo Sapiens
  allele 24: 99-23934-353 : polymorphic base G or A
ggcacttccttctttaacttcttrtgaaactagaggattaagaataa

SEQ ID NO: 3140 - DNA, 47 bp, Homo Sapiens
  allele 24: 99-23936-216 : polymorphic base T or C
gacgcttctagctttcacttctgytccctctacatggaacatgttga

SEQ ID NO: 3141 - DNA, 47 bp, Homo Sapiens
  allele 24: 99-23938-414 : polymorphic base G or A
tctatgactatagaataggaaaarataataccttcagaggacagtat

SEQ ID NO: 3142 - DNA, 47 bp, Homo Sapiens
  allele 24: 99-23943-245 : polymorphic base A or G
aggtactgcataactggcatgtgrgttgttttgctgctaggggccag

SEQ ID NO: 3143 - DNA, 47 bp, Homo Sapiens
  allele 24: 99-23960-298 : polymorphic base T or C
tgagctcatactgtcaggcactgytaggtgctttacaggcaaggttt

SEQ ID NO: 3144 - DNA, 47 bp, Homo Sapiens
  allele 24: 99-23965-360 : polymorphic base C or T
agatttttctctgcttgctccttytctggtgttttgtcattgttgat

SEQ ID NO: 3145 - DNA, 47 bp, Homo Sapiens
  allele 24: 99-23977-141 : polymorphic base G or A
tgcattttggcagtatcctgccarttttccacatccagctgttcaca

SEQ ID NO: 3146 - DNA, 47 bp, Homo Sapiens
  allele 24: 99-23987-115 : polymorphic base C or T
tgagggcagtattaggaaaggcayggacattcttttaaaatgtctag

SEQ ID NO: 3147 - DNA, 47 bp, Homo Sapiens
  allele 24: 99-23988-441 : polymorphic base C or T
atccttagtacaatacatatttcyaaaccaatcaaaaaaggtaacac

SEQ ID NO: 3148 - DNA, 47 bp, Homo Sapiens
  allele 24: 99-23995-407 : polymorphic base A or G
ttagacaggtagatactgttacartctccttctacagacaatgccac

SEQ ID NO: 3149 - DNA, 47 bp, Homo Sapiens
  allele 24: 99-24000-316 : polymorphic base C or T
gctaggatttcattgtttaataaytgcaactaagacatgtccagaaa

SEQ ID NO: 3150 - DNA, 47 bp, Homo Sapiens
  allele 24: 99-24003-172 : polymorphic base T or C
gctagacttccaaagcacatgatygggttgaatcatcccgaccttct

SEQ ID NO: 3151 - DNA, 47 bp, Homo Sapiens
  allele 24: 99-24004-200 : polymorphic base A or G
ctgcaaacgcagctcccagatttrgccctattgtttctcccctgcct

SEQ ID NO: 3152 - DNA, 47 bp, Homo Sapiens
  allele 24: 99-24007-362 : polymorphic base T or C
tcctgaaacaccaggctagccgcyggagtgtgtgctgaacatccagc

SEQ ID NO: 3153 - DNA, 47 bp, Homo Sapiens
  allele 24: 99-24020-379 : polymorphic base C or A
aagaaaatggagaagatacagggmagaggcatatggtgaaatgggtg

SEQ ID NO: 3154 - DNA, 47 bp, Homo Sapiens
  allele 24: 99-24038-103 : polymorphic base C or T
cctcagtatgagggaaactgaggyaggtgagatgcagccctccagaa

SEQ ID NO: 3155 - DNA, 47 bp, Homo Sapiens
  allele 24: 99-24063-363 : polymorphic base T or C
tgcctttatcacagtgttagtccygcaccacccccacccctgacagc

SEQ ID NO: 3156 - DNA, 47 bp, Homo Sapiens
  allele 24: 99-24073-384 : polymorphic base G or A
ggaattcattctgagcttcggtcrcgttccagttcaggctaggtctg

SEQ ID NO: 3157 - DNA, 47 bp, Homo Sapiens
  allele 24: 99-24075-45 : polymorphic base T or G
ctcccagagaattggagcacccakctccctccccaggaaatcatatc

SEQ ID NO: 3158 - DNA, 47 bp, Homo Sapiens
  allele 24: 99-24079-268 : polymorphic base C or A
aacacatgccttcacctttccaamgctacagacggagaccttgccct

SEQ ID NO: 3159 - DNA, 47 bp, Homo Sapiens
  allele 24: 99-24084-110 : polymorphic base G or A
ctaaggctatagccctttccaggraaaacagtgagttttaattgact

SEQ ID NO: 3160 - DNA, 47 bp, Homo Sapiens
  allele 24: 99-24092-209 : polymorphic base A or G
gaatgactcagaggctagggctcraacatggaggctgggtcgctgcc

SEQ ID NO: 3161 - DNA, 47 bp, Homo Sapiens
  allele 24: 99-24096-386 : polymorphic base T or A
gcctggcacacaccgctgctcgawgaaccttgatttaatgaatatgc

SEQ ID NO: 3162 - DNA, 47 bp, Homo Sapiens
  allele 24: 99-24105-247 : polymorphic base C or T
ctcctgctctgaggctgacatccygttggggagtaaaggcaatagag

SEQ ID NO: 3163 - DNA, 47 bp, Homo Sapiens
  allele 24: 99-24113-332 : polymorphic base A or G
gtgcaggggtgcgtgcacgctggraaactgtgtagcagtaaccacta

SEQ ID NO: 3164 - DNA, 47 bp, Homo Sapiens
  allele 24: 99-24117-169 : polymorphic base A or G
cacctacaccagggtttgggagcraggaccagggttggggaagcact

SEQ ID NO: 3165 - DNA, 47 bp, Homo Sapiens
  allele 24: 99-24119-368 : polymorphic base T or G
atatttgccagggaccaacagagkcagcaggggaagcctgagataac

SEQ ID NO: 3166 - DNA, 47 bp, Homo Sapiens
  allele 24: 99-24123-125 : polymorphic base A or G
caaaaaatgtgtgttgtattctartcctttcatagctttattttatc

SEQ ID NO: 3167 - DNA, 47 bp, Homo Sapiens
  allele 24: 99-24140-394 : polymorphic base G or A
tgggtgggcagcagacagctgacrggctggaattccagacggggaag

SEQ ID NO: 3168 - DNA, 47 bp, Homo Sapiens
  allele 24: 99-24148-332 : polymorphic base A or C
atcaaatacattaatatttctacmgcaaaacgtggatattcatccaa

SEQ ID NO: 3169 - DNA, 47 bp, Homo Sapiens
  allele 24: 99-24152-268 : polymorphic base C or T
ttctgctattgtatattttattaygagagatgccccagcagccctgg

SEQ ID NO: 3170 - DNA, 47 bp, Homo Sapiens
  allele 24: 99-24155-271 : polymorphic base A or C
tccctggggaattcctccctcagmccctccatgaaggctggaggccc

SEQ ID NO: 3171 - DNA, 47 bp, Homo Sapiens
  allele 24: 99-24156-107 : polymorphic base C or T
cctccctctgtattttgggacaaygtcattagctttgagcatcagga

SEQ ID NO: 3172 - DNA, 47 bp, Homo Sapiens
  allele 24: 99-24167-85 : polymorphic base A or C
tcagacctcagattaaattgaacmgcattgatcctcctccagcaggt

SEQ ID NO: 3173 - DNA, 47 bp, Homo Sapiens
  allele 24: 99-24175-218 : polymorphic base A or G
agctgatacctgagcccgggtgcrtgattgcgaatccagcttgggtt

SEQ ID NO: 3174 - DNA, 47 bp, Homo Sapiens
  allele 24: 99-24180-390 : polymorphic base A or G
cccgtctctcctcaccttggacartgacccctggcatttggcccagg

SEQ ID NO: 3175 - DNA, 47 bp, Homo Sapiens
  allele 24: 99-24182-326 : polymorphic base C or A
gttttgaaatggcttctttttacmctgagctgcactaaattttagct

SEQ ID NO: 3176 - DNA, 47 bp, Homo Sapiens
  allele 24: 99-24185-446 : polymorphic base T or C
caacagctcaaactattacaaagytcctgttttagtagagattaaat

SEQ ID NO: 3177 - DNA, 47 bp, Homo Sapiens
  allele 24: 99-24187-142 : polymorphic base A or G
gtgtcatgttagaaaatcaattcrtatgatgaattctaagtatattg

SEQ ID NO: 3178 - DNA, 47 bp, Homo Sapiens
  allele 24: 99-24190-231 : polymorphic base G or C
agacctccacaaatgtcttcatgsaaacttgcattgcataggtgata

SEQ ID NO: 3179 - DNA, 47 bp, Homo Sapiens
  allele 24: 99-24202-433 : polymorphic base C or G
gaggctaattctaaagaaggaggsctaaaggcaaaagacttcttcat

SEQ ID NO: 3180 - DNA, 47 bp, Homo Sapiens
  allele 24: 99-24204-486 : polymorphic base T or C
  misc_feature 34: n=a, g, c or t
tgacctacttctacttgcttgagygagaggcccnagtgagatacctg

SEQ ID NO: 3181 - DNA, 47 bp, Homo Sapiens
  allele 24: 99-24208-292 : polymorphic base T or A
aaccaaaaatcactcacctgtcawcgcatcatggcaatatgaaagga

SEQ ID NO: 3182 - DNA, 47 bp, Homo Sapiens
  allele 24: 99-24210-111 : polymorphic base G or A
ttgctcccgtctctataaaccctrgtctcaggacaactccacttgcc

SEQ ID NO: 3183 - DNA, 47 bp, Homo Sapiens
  allele 24: 99-24217-206 : polymorphic base T or C
agtcctcagtttccttattataayggagctgagcctgagaaagcatc

SEQ ID NO: 3184 - DNA, 47 bp, Homo Sapiens
  allele 24: 99-24225-439 : polymorphic base A or G
tggccatggctggtcaaggggacrtgggcgactcaggcctggcccct

SEQ ID NO: 3185 - DNA, 47 bp, Homo Sapiens
  allele 24: 99-24228-386 : polymorphic base G or C
gaggtgttccatgccagtctcctscatctcctagccatgtgaccttg

SEQ ID NO: 3186 - DNA, 47 bp, Homo Sapiens
  allele 24: 99-24232-419 : polymorphic base A or G
gagatgcctaggcttttccagccratggagctgggtgtctgatgcct

SEQ ID NO: 3187 - DNA, 47 bp, Homo Sapiens
  allele 24: 99-24234-352 : polymorphic base A or G
ggtcaaggcccggattccaccctragacaactgaattcacagctctt

SEQ ID NO: 3188 - DNA, 47 bp, Homo Sapiens
  allele 24: 99-24369-263 : polymorphic base G or C
caacagtaacccaaaaggcagcasaaagaaccccaattgaaagtcat

SEQ ID NO: 3189 - DNA, 47 bp, Homo Sapiens
  allele 24: 99-24397-315 : polymorphic base G or C
ggatacctgcctcctttgatgtastgtgagctgttcataggcaggga

SEQ ID NO: 3190 - DNA, 47 bp, Homo Sapiens
  allele 24: 99-24408-202 : polymorphic base A or G
ggttttgctcaactacaaagtgtrtgagggggcagtgagggggagat

SEQ ID NO: 3191 - DNA, 47 bp, Homo Sapiens
  allele 24: 99-2441-512 : polymorphic base A or G
gaagtcatccctggttttaaatgraaattagacctgctttgggactt

SEQ ID NO: 3192 - DNA, 47 bp, Homo Sapiens
  allele 24: 99-24412-279 : polymorphic base C or T
ccctttgtacaaggctaatctttyggggtaagcttgatttccaaggc

SEQ ID NO: 3193 - DNA, 47 bp, Homo Sapiens
  allele 24: 99-24415-85 : polymorphic base T or C
agccagggctttgtttgtttgggyttttacaggttggtttttgctct

SEQ ID NO: 3194 - DNA, 47 bp, Homo Sapiens
  allele 24: 99-24470-168 : polymorphic base G or A
ccgcaatgcacaggacagcccccraaacaaaaagttacctagcttcc

SEQ ID NO: 3195 - DNA, 47 bp, Homo Sapiens
  allele 24: 99-24472-179 : polymorphic base A or G
cagcagtaatttgcattagacacracgcacacttgctttcatttctc

SEQ ID NO: 3196 - DNA, 47 bp, Homo Sapiens
  allele 24: 99-24480-44 : polymorphic base A or C
tkscccagagactgtgtggcctgmacaacctgaaatattcactgttt

SEQ ID NO: 3197 - DNA, 47 bp, Homo Sapiens
  allele 24: 99-24485-55 : polymorphic base G or T
gacaagtgacatgaccccagacakgttgtttctgagccccagtttcc

SEQ ID NO: 3198 - DNA, 47 bp, Homo Sapiens
  allele 24: 99-24490-363 : polymorphic base A or G
gcatcctttcctacttgctatgaratgcctctcatgcttacttgatt

SEQ ID NO: 3199 - DNA, 47 bp, Homo Sapiens
  allele 24: 99-24492-351 : polymorphic base C or G
aggaaagcatcgccagtgtggggsagatgcaaggtcccggggtgaca

SEQ ID NO: 3200 - DNA, 47 bp, Homo Sapiens
  allele 24: 99-24581-253 : polymorphic base G or A
tggtataatggcatggttgggggrtattatgggatgtaattgtctcc

SEQ ID NO: 3201 - DNA, 47 bp, Homo Sapiens
  allele 24: 99-24591-33 : polymorphic base T or C
tactttctccagcatagcaaaagyatccccagaggcaggagagggta

SEQ ID NO: 3202 - DNA, 47 bp, Homo Sapiens
  allele 24: 99-24592-55 : polymorphic base C or T
acaatacagccctattgtgcataytccactagaggtagggtactgtg

SEQ ID NO: 3203 - DNA, 47 bp, Homo Sapiens
  allele 24: 99-24745-413 : polymorphic base T or C
gcaccaccacctgtacagacattygcaagaaaaaaatgcactgaaag

SEQ ID NO: 3204 - DNA, 47 bp, Homo Sapiens
  allele 24: 99-24753-182 : polymorphic base G or A
aggtcaatgttgggattaaggacrctcaaactttagtggtacccaac

SEQ ID NO: 3205 - DNA, 47 bp, Homo Sapiens; identical to SEQ ID NO: 3117
  allele 24: 99-24768-233 : polymorphic base C or T

SEQ ID NO: 3206 - DNA, 47 bp, Homo Sapiens
  allele 24: 99-24855-180 : polymorphic base C or T
atatgaaatacaaaacacaatatyagaatatttgtaaaggcaatgga

SEQ ID NO: 3207 - DNA, 47 bp, Homo Sapiens
  allele 24: 99-24863-199 : polymorphic base C or T
ataaaatacatgaccacaattagygggcagaagcaaatctccctgga

SEQ ID NO: 3208 - DNA, 47 bp, Homo Sapiens
  allele 24: 99-24867-219 : polymorphic base G or A
tatcaaagactgccccagtctgtrtgtgtgtcctaaattgcaattct

SEQ ID NO: 3209 - DNA, 45 bp, Homo Sapiens
  allele 24: 99-24871-435 : polymorphic base A or G
gaaaccagttataaaagtttaagrgaacagctaacacagatgtat

SEQ ID NO: 3210 - DNA, 47 bp, Homo Sapiens
  allele 24: 99-24889-311 : polymorphic base T or A
caaatttggggttctggaagctgwtgcagatgcttagagtggaaagt

SEQ ID NO: 3211 - DNA, 47 bp, Homo Sapiens
  allele 24: 99-24897-276 : polymorphic base C or G
aacttcattattttgatactgtasaaagttgacctttagttctagtt

SEQ ID NO: 3212 - DNA, 47 bp, Homo Sapiens
  allele 24: 99-24904-187 : polymorphic base T or C
aacacagagattccaaaagagagyatcacctaacaagtgaaaaggcc

SEQ ID NO: 3213 - DNA, 47 bp, Homo Sapiens
  allele 24: 99-24909-440 : polymorphic base A or G
tctagctcatggctgctggaaatrgttggcaatctctctctctccaa

SEQ ID NO: 3214 - DNA, 47 bp, Homo Sapiens
  allele 24: 99-24917-250 : polymorphic base G or A
gtcactgctcttctacaatgtgcrgaacatgtgctcaggtaatagcg

SEQ ID NO: 3215 - DNA, 47 bp, Homo Sapiens
  allele 24: 99-24930-299 : polymorphic base A or G
aatctttgtcctttgagtccctcrttcagccagcgtcagttgcgtgg

SEQ ID NO: 3216 - DNA, 47 bp, Homo Sapiens
  allele 24: 99-24936-332 : polymorphic base G or T
gggatttttttttttttaaagagkttatttatactcttttagagctt

SEQ ID NO: 3217 - DNA, 47 bp, Homo Sapiens
  allele 24: 99-24965-416 : polymorphic base G or C
cggccccagcgctatgcccttctsaggcctgctctgcacacacagct

SEQ ID NO: 3218 - DNA, 47 bp, Homo Sapiens
  allele 24: 99-24966-423 : polymorphic base C or T
cttgggctggccctgccccacccytccccaccaagccgcttggctcg

SEQ ID NO: 3219 - DNA, 47 bp, Homo Sapiens
  allele 24: 99-25020-395 : polymorphic base C or G
ctattgaatagcaacattctaaasatattcccatcttagttataatt

SEQ ID NO: 3220 - DNA, 47 bp, Homo Sapiens
  allele 24: 99-25362-247 : polymorphic base T or C
tgtcctgtatacagttgggaagayggatgcatattctcatgggagaa

SEQ ID NO: 3221 - DNA, 47 bp, Homo Sapiens
  allele 24: 99-25394-261 : polymorphic base T or C
ggccagtaaagtgtcagcccaacygtggtccctgtgcctaaaaacaa

SEQ ID NO: 3222 - DNA, 47 bp, Homo Sapiens
  allele 24: 99-25406-54 : polymorphic base G or C
tgggaggttatgtttatttgagasttctccatcgggatcgcctggtg

SEQ ID NO: 3223 - DNA, 47 bp, Homo Sapiens
  allele 24: 99-25446-121 : polymorphic base C or A
caggtcagggtgggttgtgatgamgcttagaggccaggattcctgct

SEQ ID NO: 3224 - DNA, 47 bp, Homo Sapiens
  allele 24: 99-25496-221 : polymorphic base C or T
aaaataaagcagattgacagagcyctcaactattgtcttcatcatta

SEQ ID NO: 3225 - DNA, 47 bp, Homo Sapiens
  allele 24: 99-25497-242 : polymorphic base G or A
attaagttaaggactttgagatgrggagatggtcctggattatctgg

SEQ ID NO: 3226 - DNA, 47 bp, Homo Sapiens
  allele 24: 99-2559-253 : polymorphic base T or G
caggtgttttcatgccctcttagkgtgtgtcacatcatccatctcaa

SEQ ID NO: 3227 - DNA, 47 bp, Homo Sapiens
  allele 24: 99-25654-281 : polymorphic base G or A
tcaaaagctgcagggctctgctartttcaaaagtcacataaacctta

SEQ ID NO: 3228 - DNA, 47 bp, Homo Sapiens
  allele 24: 99-2566-112 : polymorphic base A or G
gccttcacaaccgcagaggcaagrgaaggagcttggccaccctgact

SEQ ID NO: 3229 - DNA, 47 bp, Homo Sapiens
  allele 24: 99-2567-329 : polymorphic base T or G
cactgtcagatatgaaatgatgcktggctttctttgggctatatttg

SEQ ID NO: 3230 - DNA, 47 bp, Homo Sapiens
  allele 24: 99-2571-242 : polymorphic base G or A
ataatgaatgagtatttgatattrtataattaaatgtgtcagcattt

SEQ ID NO: 3231 - DNA, 47 bp, Homo Sapiens
  allele 24: 99-25738-218 : polymorphic base C or T
ggaggggtggtggtgtatttttcyccttttttccttcctctcctaca

SEQ ID NO: 3232 - DNA, 47 bp, Homo Sapiens
  allele 24: 99-25755-364 : polymorphic base A or G
cctcataaatgcaaaaagttcatrtaggagaatatttaaaatgaata

SEQ ID NO: 3233 - DNA, 47 bp, Homo Sapiens
  allele 24: 99-25834-70 : polymorphic base T or G
ttgggtgccaaacttctgcttagkgcaggcatgaagcaaaaagtctg

SEQ ID NO: 3234 - DNA, 47 bp, Homo Sapiens
  allele 24: 99-25843-256 : polymorphic base A or C
ggtattatctagtatattccccamtgcctccattttgcagatgagga

SEQ ID NO: 3235 - DNA, 47 bp, Homo Sapiens
  allele 24: 99-26051-273 : polymorphic base G or A
tgaaacaactgtaacatcttaccrgttccctcattagttaatgaatt

SEQ ID NO: 3236 - DNA, 47 bp, Homo Sapiens
  allele 24: 99-26058-275 : polymorphic base G or C
cccagccaccctctcttccaacastcctccaattttctgcatagtta

SEQ ID NO: 3237 - DNA, 47 bp, Homo Sapiens
  allele 24: 99-26074-400 : polymorphic base A or C
gtagggggcttgtaacatgcagamaagtttgaaagttgctttaggag

SEQ ID NO: 3238 - DNA, 47 bp, Homo Sapiens
  allele 24: 99-26076-376 : polymorphic base G or A
agagggagacaggactcaccaagrtggatgctggtggccaagcagca

SEQ ID NO: 3239 - DNA, 47 bp, Homo Sapiens
  allele 24: 99-2630-67 : polymorphic base G or A
taaattctgcctagaagattaagrttggtccagaacagggagtgttt

SEQ ID NO: 3240 - DNA, 47 bp, Homo Sapiens
  allele 24: 99-2633-129 : polymorphic base C or A
tagctatttcttcccctaggcaamgtagacaatgagagaacccttga

SEQ ID NO: 3241 - DNA, 47 bp, Homo Sapiens
  allele 24: 99-2634-341 : polymorphic base G or A
ggaatcaatatttatttattatcracaggtgagacattatttattta

SEQ ID NO: 3242 - DNA, 47 bp, Homo Sapiens
  allele 24: 99-2636-64 : polymorphic base A or T
acacaagtccagggcttttcctawtgagcctaaccttcgtttttcag

SEQ ID NO: 3243 - DNA, 47 bp, Homo Sapiens
  allele 24: 99-2642-255 : polymorphic base A or G
tgagggtgtttccagaagagactrgcatttgaatctgaagtgagtaa

SEQ ID NO: 3244 - DNA, 47 bp, Homo Sapiens
  allele 24: 99-2645-118 : polymorphic base T or G
cacaaattaattgcattgttatakgctagcaatgaagaatctgaaaa

SEQ ID NO: 3245 - DNA, 47 bp, Homo Sapiens
  allele 24: 99-2647-368 : polymorphic base G or A
ttaaggccttcaactgattagacraggcccactcacattatctgaca

SEQ ID NO: 3246 - DNA, 47 bp, Homo Sapiens
  allele 24: 99-2649-107 : polymorphic base T or A
cacaactctggagccttttatgawcaggacagcaatgcactgaaact

SEQ ID NO: 3247 - DNA, 47 bp, Homo Sapiens
  allele 24: 99-2711-269 : polymorphic base A or G
tcaaaaatatactgctttagcccrttgtgtatttgatcaaaactgac

SEQ ID NO: 3248 - DNA, 47 bp, Homo Sapiens
  allele 24: 99-2712-52 : polymorphic base C or T
ttgttagttggatccatcagcctygctatcctaagcattcttctctt

SEQ ID NO: 3249 - DNA, 47 bp, Homo Sapiens
  allele 24: 99-2718-202 : polymorphic base C or T
tgctgatacccagtagacattcgytacttgattggagctagagtttt

SEQ ID NO: 3250 - DNA, 47 bp, Homo Sapiens
  allele 24: 99-2719-419 : polymorphic base T or C
aataagtggatggaactgccaacyctggaaagatgaagaacggatat

SEQ ID NO: 3251 - DNA, 47 bp, Homo Sapiens
  allele 24: 99-2726-364 : polymorphic base C or G
tgaggcagaagtggtaaagcagasagcacgaactattccaggtactg

SEQ ID NO: 3252 - DNA, 47 bp, Homo Sapiens
  allele 24: 99-2734-400 : polymorphic base T or G
ttcattaaatatacatacatagakatatatatatgcatttaattaat

SEQ ID NO: 3253 - DNA, 47 bp, Homo Sapiens
  allele 24: 99-2740-351 : polymorphic base T or G
aattaatccaaaatggatgttttkactgatgatccttgaactcacaa

SEQ ID NO: 3254 - DNA, 47 bp, Homo Sapiens
  allele 24: 99-2752-213 : polymorphic base C or G
acaggtaagtcctcttgccgaatstgatggtctcctaactcagggat

SEQ ID NO: 3255 - DNA, 47 bp, Homo Sapiens
  allele 24: 99-2760-182 : polymorphic base A or G
ctgcacctttcttcccaagcccartcctacctctgactctgcccaag

SEQ ID NO: 3256 - DNA, 47 bp, Homo Sapiens
  allele 24: 99-2761-223 : polymorphic base A or G
gagaagcaggagctctggggagargatgatgtcttcttggagtctgc

SEQ ID NO: 3257 - DNA, 47 bp, Homo Sapiens
  allele 24: 99-2765-279 : polymorphic base A or G
gggactgttaccccaggggctttrgcctcttacctggtgcaggcaac

SEQ ID NO: 3258 - DNA, 47 bp, Homo Sapiens
  allele 24: 99-2790-217 : polymorphic base T or C
aaagcaagagcttagaaagtactycacccaggtatccctcttggaaa

SEQ ID NO: 3259 - DNA, 47 bp, Homo Sapiens
  allele 24: 99-2797-399 : polymorphic base C or T
ttataaaggaagaaaaaggtagcygacttcgtttgttctgcttaatg

SEQ ID NO: 3260 - DNA, 47 bp, Homo Sapiens
  allele 24: 99-2816-62 : polymorphic base G or A
tgccctccctgctggaccaccccrctgtcctacgtgttacctgacgt

SEQ ID NO: 3261 - DNA, 47 bp, Homo Sapiens
  allele 24: 99-2817-88 : polymorphic base G or C
  misc_feature 9: n=a, g, c or t
cagcttggngtgggaggctgtcasgaggttagtatcgtgttaaaaaa

SEQ ID NO: 3262 - DNA, 47 bp, Homo Sapiens
  allele 24: 99-2819-108 : polymorphic base A or G
ggagagagcgtgatggggcagccrcagccttcccaggcctgggggag

SEQ ID NO: 3263 - DNA, 47 bp, Homo Sapiens
  allele 24: 99-2820-199 : polymorphic base A or G
cccgatgcaggcccagcatccacrgggtaaaggggctcagactcaat

SEQ ID NO: 3264 - DNA, 47 bp, Homo Sapiens
  allele 24: 99-2832-152 : polymorphic base C or T
ctggccgaagctaagcctccgtcyctccctcgccctccctgcagacc

SEQ ID NO: 3265 - DNA, 47 bp, Homo Sapiens
  allele 24: 99-2868-277 : polymorphic base G or C
gccaggtggaaaagaacacaggtstgggaatcaggagacctgggttc

SEQ ID NO: 3266 - DNA, 47 bp, Homo Sapiens
  allele 24: 99-2870-70 : polymorphic base A or G
acttagtgcctcgtcaggggccartgaaagggaaggaggtgagggcg

SEQ ID NO: 3267 - DNA, 47 bp, Homo Sapiens
  allele 24: 99-2881-61 : polymorphic base T or A
ttctggcatttaaagaatgggaawaccgcaattacttttgcgtcaac

SEQ ID NO: 3268 - DNA, 47 bp, Homo Sapiens
  allele 24: 99-2895-47 : polymorphic base A or G
gtttcttccagtctgttattggtrtcctttgctctgatctcctttcg

SEQ ID NO: 3269 - DNA, 47 bp, Homo Sapiens
  allele 24: 99-2903-265 : polymorphic base A or T
gaaataataccctagggaaacctwtctagaaaaatatctaagaaatg

SEQ ID NO: 3270 - DNA, 47 bp, Homo Sapiens
  allele 24: 99-2906-80 : polymorphic base C or T
acagttttcagtatttccctctaytggtatttgtgggtgcccttcaa

SEQ ID NO: 3271 - DNA, 47 bp, Homo Sapiens
  allele 24: 99-2914-48 : polymorphic base A or G
atctgtagatcactttgggtagtrtggacattttatcaattttaatt

SEQ ID NO: 3272 - DNA, 47 bp, Homo Sapiens
  allele 24: 99-2922-171 : polymorphic base G or A
atcttgttggtgtcagcagagagrggcataaatctcaaaaggcagtg

SEQ ID NO: 3273 - DNA, 47 bp, Homo Sapiens
  allele 24: 99-2924-183 : polymorphic base T or C
taaatatcatattttattcccacyataatccatataaaacatacatt

SEQ ID NO: 3274 - DNA, 47 bp, Homo Sapiens
  allele 24: 99-2926-184 : polymorphic base G or A
gtcagaatctgaattttaacaagrtccctgggtgatttgtgtgcacc

SEQ ID NO: 3275 - DNA, 47 bp, Homo Sapiens
  allele 24: 99-2928-52 : polymorphic base G or A
aagtgttcttctgcttcatttttrtgattcattctctttttagcatc

SEQ ID NO: 3276 - DNA, 47 bp, Homo Sapiens
  allele 24: 99-2938-83 : polymorphic base T or C
aaaagtgctccaggtgattctagygtgtatcaagcaagacttgtgaa

SEQ ID NO: 3277 - DNA, 47 bp, Homo Sapiens
  allele 24: 99-2943-230 : polymorphic base T or G
ggaggatcctttcttgggctgtaktttttaatcctcaaaaatataat

SEQ ID NO: 3278 - DNA, 47 bp, Homo Sapiens
  allele 24: 99-2944-351 : polymorphic base C or T
tcatatttgaaaaaactggacacyactgtcctagaacttctattaat

SEQ ID NO: 3279 - DNA, 47 bp, Homo Sapiens
  allele 24: 99-295-355 : polymorphic base T or C
ggaaagaagttccctcccttgatygtctccaaaccctttgaaagttt

SEQ ID NO: 3280 - DNA, 47 bp, Homo Sapiens
  allele 24: 99-2954-160 : polymorphic base C or G
gaggcccaggggaagccagtcctsgtggtagagactgcctgccagga

SEQ ID NO: 3281 - DNA, 47 bp, Homo Sapiens
  allele 24: 99-2956-239 : polymorphic base C or T
actctcgctgccagaccctgggcyggggaggggtttgggggaactgg

SEQ ID NO: 3282 - DNA, 47 bp, Homo Sapiens
  allele 24: 99-2970-318 : polymorphic base G or C
ggctgttaattcaggaggtaaagsagacactcattactcactgggtt

SEQ ID NO: 3283 - DNA, 47 bp, Homo Sapiens
  allele 24: 99-2978-135 : polymorphic base C or A
aacaataaaggattagatttagamatatcagcaggaatttaaaaagt

SEQ ID NO: 3284 - DNA, 47 bp, Homo Sapiens
  allele 24: 99-2981-53 : polymorphic base T or C
tatatttcagtatggtagaagacyaggagtgaaaagagaagactatc

SEQ ID NO: 3285 - DNA, 47 bp, Homo Sapiens
  allele 24: 99-2988-243 : polymorphic base C or T
gaagcccagcaaaacttccattaycctccacatccataatttatcct

SEQ ID NO: 3286 - DNA, 47 bp, Homo Sapiens
  allele 24: 99-2989-345 : polymorphic base C or A
tagatcttaaataatttagataamcatagtggccatttagattattg

SEQ ID NO: 3287 - DNA, 47 bp, Homo Sapiens
  allele 24: 99-2991-256 : polymorphic base G or A
ttgatgaagattgcactaatcttrtaaaataacttggaggggaatgt

SEQ ID NO: 3288 - DNA, 47 bp, Homo Sapiens
  allele 24: 99-2995-168 : polymorphic base C or T
ttgcatcactggatgcccttgacygaaagctggcttatggcatctca

SEQ ID NO: 3289 - DNA, 47 bp, Homo Sapiens
  allele 24: 99-2999-371 : polymorphic base C or T
aagatattaaacagagttacatayacttacaacttcatacatatata

SEQ ID NO: 3290 - DNA, 47 bp, Homo Sapiens
  allele 24: 99-3013-250 : polymorphic base A or T
ttagcaatgctgttcacttgcttwttctgctgtaagaattaaaatca

SEQ ID NO: 3291 - DNA, 47 bp, Homo Sapiens
  allele 24: 99-3018-50 : polymorphic base A or G
tgaaaatactggtgtattgccaargattgagagtctggaagggaaag

SEQ ID NO: 3292 - DNA, 47 bp, Homo Sapiens
  allele 24: 99-3019-316 : polymorphic base A or T
acattcttcatagcattttagaawcattttgtcctacacttgtgcat

SEQ ID NO: 3293 - DNA, 47 bp, Homo Sapiens
  allele 24: 99-3020-369 : polymorphic base A or G
ttgaaaaacctacaaaagttattrtgatctccaccttgaaccttata

SEQ ID NO: 3294 - DNA, 47 bp, Homo Sapiens
  allele 24: 99-3021-290 : polymorphic base A or G
aactttgcattcttggggacaggrgggctgaaacagaattgcagcat

SEQ ID NO: 3295 - DNA, 47 bp, Homo Sapiens
  allele 24: 99-3044-216 : polymorphic base C or T
tactagcatctactaggtagaggygaagaatactgccaaacatccta

SEQ ID NO: 3296 - DNA, 47 bp, Homo Sapiens
  allele 24: 99-3045-108 : polymorphic base C or T
gtgtgtttctaaagatggctcaaygtgatttgcttgccatgtgatct

SEQ ID NO: 3297 - DNA, 47 bp, Homo Sapiens
  allele 24: 99-3046-91 : polymorphic base T or C
ccagtcaatgaaggtggacagatytgtggtcactccaatctatgtga

SEQ ID NO: 3298 - DNA, 47 bp, Homo Sapiens
  allele 24: 99-3047-395 : polymorphic base G or A
gatctataggagaatccatggtgragccttatcttttgtcatatgag

SEQ ID NO: 3299 - DNA, 47 bp, Homo Sapiens
  allele 24: 99-3058-420 : polymorphic base T or A
gagaccatatttatttctatgtawgttacaaatcaaagtttatgcct

SEQ ID NO: 3300 - DNA, 47 bp, Homo Sapiens
  allele 24: 99-306-119 : polymorphic base G or A
ccgtaaggtggggctggtcagaartgggataggttggggcccaggct

SEQ ID NO: 3301 - DNA, 47 bp, Homo Sapiens
  allele 24: 99-3061-369 : polymorphic base A or G
taatttcacgtttattattttccrtttggattcatactttgaaattg

SEQ ID NO: 3302 - DNA, 47 bp, Homo Sapiens
  allele 24: 99-3106-272 : polymorphic base G or A
tccccagggcccatgtaaactacrcccgaatgctcatgcctggccca

SEQ ID NO: 3303 - DNA, 47 bp, Homo Sapiens
  allele 24: 99-3108-156 : polymorphic base A or T
cagtgaggggtgcatggcacagcwgttaaaaagaaacaaaaacttgt

SEQ ID NO: 3304 - DNA, 47 bp, Homo Sapiens
  allele 24: 99-3109-402 : polymorphic base G or A
aatgtattgccactgaaggagtcrgtgtctgacgatcagctccacca

SEQ ID NO: 3305 - DNA, 47 bp, Homo Sapiens
  allele 24: 99-3110-321 : polymorphic base C or T
accaactgtagagttcatatttcygctgaatagatgatgaataagta

SEQ ID NO: 3306 - DNA, 47 bp, Homo Sapiens
  allele 24: 99-312-311 : polymorphic base C or T
agctctgcccatgtgacagtgtayttttcagggtgagtgttgggggg

SEQ ID NO: 3307 - DNA, 47 bp, Homo Sapiens
  allele 24: 99-3129-113 : polymorphic base T or A
gctgcccctcaggccatgacaccwcggccagtggtctctcctgggtc

SEQ ID NO: 3308 - DNA, 47 bp, Homo Sapiens
  allele 24: 99-3132-158 : polymorphic base A or G
ctagctctggacatgccttgggargctggctatgattcatgaccttt

SEQ ID NO: 3309 - DNA, 47 bp, Homo Sapiens
  allele 24: 99-3144-112 : polymorphic base A or G
  misc_feature 14: n=a, g, c or t
tgcctgaatggtanagtgagttgrcgctgggattcctggccctgccc

SEQ ID NO: 3310 - DNA, 47 bp, Homo Sapiens
  allele 24: 99-3147-24 : polymorphic base C or G
tgaggtaaaggagaggagggaaascaggtgtttatgcagaaactgta

SEQ ID NO: 3311 - DNA, 47 bp, Homo Sapiens
  allele 24: 99-3153-190 : polymorphic base C or T
gaaaggcagggtggctgcacattytggggctcagatcaccattggct

SEQ ID NO: 3312 - DNA, 47 bp, Homo Sapiens
  allele 24: 99-3154-110 : polymorphic base T or C
atggagccaagcgttttgtgaaaygactaggatttttttttctcctg

SEQ ID NO: 3313 - DNA, 47 bp, Homo Sapiens
  allele 24: 99-3156-251 : polymorphic base T or C
gagccacatctgttgggtattagyggtccatgagggttaattgcctc

SEQ ID NO: 3314 - DNA, 47 bp, Homo Sapiens
  allele 24: 99-3167-227 : polymorphic base A or G
ccagaggcccatcgaggagatgcrctgtgcacagggctgtgggcaag

SEQ ID NO: 3315 - DNA, 47 bp, Homo Sapiens
  allele 24: 99-3195-71 : polymorphic base G or A
cataagaatgattagattccattrgtgttcttctggggaatacttgg

SEQ ID NO: 3316 - DNA, 47 bp, Homo Sapiens
  allele 24: 99-3217-274 : polymorphic base G or A
gttaaacattaaaagctgattgarccactgcccatatacaaagcctg

SEQ ID NO: 3317 - DNA, 47 bp, Homo Sapiens
  allele 24: 99-3224-232 : polymorphic base A or G
ataaactactcttttaaataaaartatttctccagagtaaatatatt

SEQ ID NO: 3318 - DNA, 47 bp, Homo Sapiens
  allele 24: 99-3231-109 : polymorphic base T or A
atgacttctgaggctgggtcatawaaaacattgtggcttttgttttt

SEQ ID NO: 3319 - DNA, 47 bp, Homo Sapiens
  allele 24: 99-3234-274 : polymorphic base A or C
aattaaagacgtaagtcattagcmtgagtgttacttttcatctcaat

SEQ ID NO: 3320 - DNA, 47 bp, Homo Sapiens
  allele 24: 99-325-226 : polymorphic base A or C
gtgaccggagccaggcggtgaggmatggactgagggcgaaggtgctg

SEQ ID NO: 3321 - DNA, 47 bp, Homo Sapiens
  allele 24: 99-3266-193 : polymorphic base G or A
ctccaggatgaagtgcacacagtrgatgagggagcaggcgtgggtca

SEQ ID NO: 3322 - DNA, 47 bp, Homo Sapiens
  allele 24: 99-3276-195 : polymorphic base C or A
ttccatactcctagccttcctggmagacatccttttcatcctcacaa

SEQ ID NO: 3323 - DNA, 47 bp, Homo Sapiens
  allele 24: 99-3279-337 : polymorphic base T or C
aaaggtcctgcacccctggaaccycctcggtcctaggcaaaacagac

SEQ ID NO: 3324 - DNA, 47 bp, Homo Sapiens
  allele 24: 99-3293-300 : polymorphic base T or G
gctgtgtcacgccactcgccgtckctctctggtcggctccgtgaggg

SEQ ID NO: 3325 - DNA, 47 bp, Homo Sapiens
  allele 24: 99-3296-101 : polymorphic base T or A
gcagccctgacagcagtggagaawggatggggcggaggtgaaggcac

SEQ ID NO: 3326 - DNA, 47 bp, Homo Sapiens
  allele 24: 99-3299-211 : polymorphic base C or T
ggtcacgggggaagtaatgacacygtaacaacaattaaaatgggaaa

SEQ ID NO: 3327 - DNA, 47 bp, Homo Sapiens
  allele 24: 99-3305-272 : polymorphic base A or C
cacaaggcattgcctcagccaggmaagctcttcccactcttatgatt

SEQ ID NO: 3328 - DNA, 47 bp, Homo Sapiens
  allele 24: 99-3335-53 : polymorphic base C or T
caaggatcccacctccttccagcygccctgccaggcccctctccatt

SEQ ID NO: 3329 - DNA, 47 bp, Homo Sapiens
  allele 24: 99-3337-294 : polymorphic base C or T
tgccgtgaagcgggtagggggctycctccaaagcgggtggcaggcag

SEQ ID NO: 3330 - DNA, 47 bp, Homo Sapiens
  allele 24: 99-3342-103 : polymorphic base G or A
aggacttaacctcatctgctgccraatagctggctatgtgaccttgg

SEQ ID NO: 3331 - DNA, 47 bp, Homo Sapiens
  allele 24: 99-3347-226 : polymorphic base T or A
taaatgttcaatccagaattcatwctcaaagatgtcaggttttgaag

SEQ ID NO: 3332 - DNA, 47 bp, Homo Sapiens
  allele 24: 99-3349-124 : polymorphic base A or C
ggcaaataaaaaggaaacagatamgtttatacttgaggagagtgttg

SEQ ID NO: 3333 - DNA, 47 bp, Homo Sapiens
  allele 24: 99-3353-350 : polymorphic base T or C
agaaaagataaggcttctgaggcyagggggctgctggaaaaagagca

SEQ ID NO: 3334 - DNA, 47 bp, Homo Sapiens
  allele 24: 99-3356-345 : polymorphic base A or G
gttagaaatgcaaattcaactgaraaagaatatctaagtgggtggag

SEQ ID NO: 3335 - DNA, 47 bp, Homo Sapiens
  allele 24: 99-3368-277 : polymorphic base C or T
cccagcatttcgggaggctgaggygggaggaccatttgagctcaggg

SEQ ID NO: 3336 - DNA, 47 bp, Homo Sapiens
  allele 24: 99-3373-253 : polymorphic base C or G
ctgctaattccctggatgacagastgagagactgtgtctcaaaaaat

SEQ ID NO: 3337 - DNA, 47 bp, Homo Sapiens
  allele 24: 99-3374-274 : polymorphic base G or A
aagacaggccatgaggacacaaartaaggatatacagaagactaaac

SEQ ID NO: 3338 - DNA, 47 bp, Homo Sapiens
  allele 24: 99-3385-197 : polymorphic base C or T
ctttggacctgtctcatggtgtcyttatttgcaaactggttgaatca

SEQ ID NO: 3339 - DNA, 47 bp, Homo Sapiens
  allele 24: 99-3390-328 : polymorphic base G or A
atcctgaggtcctagtatgcggtraggggggctccatcagtgtgaag

SEQ ID NO: 3340 - DNA, 47 bp, Homo Sapiens
  allele 24: 99-3391-160 : polymorphic base C or T
tatcttttatactgtatttttacygtaccttttctatgtttacgtac

SEQ ID NO: 3341 - DNA, 47 bp, Homo Sapiens
  allele 24: 99-3393-245 : polymorphic base A or G
ctcttacaagcgaggagcatgagrctcatcctggattccttcctctc

SEQ ID NO: 3342 - DNA, 47 bp, Homo Sapiens
  allele 24: 99-3398-196 : polymorphic base T or C
cctgccaccaagatgctctgaaaytgtgggtgttttagcaaattcct

SEQ ID NO: 3343 - DNA, 47 bp, Homo Sapiens
  allele 24: 99-3399-449 : polymorphic base C or T
ttggtacatgcttagtgcagtaaycgtacgctctgtatgggtggaag

SEQ ID NO: 3344 - DNA, 47 bp, Homo Sapiens
  allele 24: 99-3400-83 : polymorphic base G or A
ggtaggaccaacctcagtgaactrcctttcgggagattcctcagaag

SEQ ID NO: 3345 - DNA, 47 bp, Homo Sapiens
  allele 24: 99-3414-112 : polymorphic base G or A
ggggtgtctagagtacaaagcagrcagagtaaaataaagctcctgtc

SEQ ID NO: 3346 - DNA, 47 bp, Homo Sapiens
  allele 24: 99-3415-215 : polymorphic base G or A
gcgggaaacacaggacaatgagargcctgcctgtcccacactctgac

SEQ ID NO: 3347 - DNA, 47 bp, Homo Sapiens
  allele 24: 99-3426-270 : polymorphic base C or T
aactaaagttcttatagagatacytataatttttaaatgtttatatt

SEQ ID NO: 3348 - DNA, 47 bp, Homo Sapiens
  allele 24: 99-3428-366 : polymorphic base A or G
tattgcagagaaagcctggaacartctctccatcagtaagggaccca

SEQ ID NO: 3349 - DNA, 47 bp, Homo Sapiens
  allele 24: 99-3445-239 : polymorphic base G or C
gtttgcaacaaccacagcagtcastttataaaacaatttgatcgccc

SEQ ID NO: 3350 - DNA, 47 bp, Homo Sapiens
  allele 24: 99-3453-138 : polymorphic base A or G
tgggttttggtttgtttgattctrttcctgggcaagtgacttccata

SEQ ID NO: 3351 - DNA, 47 bp, Homo Sapiens
  allele 24: 99-3460-337 : polymorphic base C or T
agcacaagaggttgggggagtcaygaaagtatgacacagatgggtgt

SEQ ID NO: 3352 - DNA, 47 bp, Homo Sapiens
  allele 24: 99-3462-117 : polymorphic base C or T
acccctgggcatagcaaaaaggcygagggaaaaagaaagcgaagcaa

SEQ ID NO: 3353 - DNA, 47 bp, Homo Sapiens
  allele 24: 99-3468-272 : polymorphic base A or G
ggtgtgtctagcgtgcttctagcrtgcttgggaacagtgtgttctct

SEQ ID NO: 3354 - DNA, 47 bp, Homo Sapiens
  allele 24: 99-3469-313 : polymorphic base C or G
ctgcatgcggcctggggccgtggsctggacgagcttggtttagaccc

SEQ ID NO: 3355 - DNA, 47 bp, Homo Sapiens
  allele 24: 99-3473-309 : polymorphic base C or G
aggacttgagccccaatcttccascttcaatccagatcatatgacag

SEQ ID NO: 3356 - DNA, 47 bp, Homo Sapiens
  allele 24: 99-3474-272 : polymorphic base A or G
ggtgtgcgtgcaacagggaccaarcaagatccccacattgtatttgg

SEQ ID NO: 3357 - DNA, 47 bp, Homo Sapiens
  allele 24: 99-3478-199 : polymorphic base G or A
cctgtaagttttactgttgagaarataacatcagcaaaatgttggca

SEQ ID NO: 3358 - DNA, 47 bp, Homo Sapiens
  allele 24: 99-3479-293 : polymorphic base T or C
ggccaaatctggcttcagaagagycaggaattggggcaaaggggaaa

SEQ ID NO: 3359 - DNA, 47 bp, Homo Sapiens
  allele 24: 99-3482-225 : polymorphic base A or G
atcacgagaaatggatcagaaacrcagcagaaggcagcctcgtggcc

SEQ ID NO: 3360 - DNA, 47 bp, Homo Sapiens
  allele 24: 99-3483-252 : polymorphic base T or C
gtagaagcaaaggaagggagatcyggggaagcagaatgtgtctgagg

SEQ ID NO: 3361 - DNA, 47 bp, Homo Sapiens
  allele 24: 99-3485-245 : polymorphic base T or A
aaacacaagtgagagtgggagagwcatggacagccacagcaggggca

SEQ ID NO: 3362 - DNA, 47 bp, Homo Sapiens
  allele 24: 99-3511-130 : polymorphic base G or A
caggactctccagtccaagggtcrgtactgagccaaaaatcagaggt

SEQ ID NO: 3363 - DNA, 47 bp, Homo Sapiens
  allele 24: 99-3519-374 : polymorphic base G or A
attaggttccagttacatactgaraatgaacaatatctaaagcttag

SEQ ID NO: 3364 - DNA, 47 bp, Homo Sapiens
  allele 24: 99-3522-210 : polymorphic base A or G
gtactaaaaattaaaatgcaaatragctggaaggtggggccaggcat

SEQ ID NO: 3365 - DNA, 47 bp, Homo Sapiens
  allele 24: 99-3523-270 : polymorphic base A or C
gtaacttaaaaaatgttttatgtmcctagtggtatataccccaagaa

SEQ ID NO: 3366 - DNA, 47 bp, Homo Sapiens
  allele 24: 99-3524-403 : polymorphic base T or A
gtgttattatgcctggaactaggwcctattgtggtgtcaattttaat

SEQ ID NO: 3367 - DNA, 47 bp, Homo Sapiens
  allele 24: 99-3542-336 : polymorphic base G or T
gatgaattacaaaggttcacagakctcagcattaccattattacttt

SEQ ID NO: 3368 - DNA, 47 bp, Homo Sapiens
  allele 24: 99-3556-129 : polymorphic base T or G
gtagcatcaagttaaatattggakccttttaatagtccctggcatgt

SEQ ID NO: 3369 - DNA, 47 bp, Homo Sapiens
  allele 24: 99-3563-121 : polymorphic base C or T
gcatctgactgaaagccaatcaaytgaatgatcaataacgtattttg

SEQ ID NO: 3370 - DNA, 47 bp, Homo Sapiens
  allele 24: 99-3580-122 : polymorphic base C or G
gatctctgcccagtggcccacatscggtcgccgtttcatcagtttcc

SEQ ID NO: 3371 - DNA, 47 bp, Homo Sapiens
  allele 24: 99-3588-188 : polymorphic base T or A
cctggcttttctagctgtcagcgwcataaaccaaaccatgcaaatga

SEQ ID NO: 3372 - DNA, 47 bp, Homo Sapiens
  allele 24: 99-3589-203 : polymorphic base C or T
caaagaacaaggagaaaatcttayttttaaaaaatagaagaaaatgc

SEQ ID NO: 3373 - DNA, 47 bp, Homo Sapiens
  allele 24: 99-3596-147 : polymorphic base C or T
gtaacttaaccaaagggtgtttayctttctcacctcatgagatgttc

SEQ ID NO: 3374 - DNA, 47 bp, Homo Sapiens
  allele 24: 99-36-69 : polymorphic base C or T
actcagcagtagtctcactgaagyatgaataaatcagcacacatgca

SEQ ID NO: 3375 - DNA, 47 bp, Homo Sapiens
  allele 24: 99-3601-226 : polymorphic base T or C
accaatttggtttgtgtggtagcycttgcaaccgatacagagttctt

SEQ ID NO: 3376 - DNA, 47 bp, Homo Sapiens
  allele 24: 99-3603-80 : polymorphic base T or A
tcagaggtctcctgttccaaattwcaaaatccaacccgggatgggaa

SEQ ID NO: 3377 - DNA, 47 bp, Homo Sapiens
  allele 24: 99-3604-91 : polymorphic base A or G
caatgcagtgatcattttgatccrtttttaaataaagcttattaatt

SEQ ID NO: 3378 - DNA, 47 bp, Homo Sapiens
  allele 24: 99-3619-330 : polymorphic base C or T
tttgggaaggccgtcctgtgcccygaagggtggtgagcggcatcccc

SEQ ID NO: 3379 - DNA, 47 bp, Homo Sapiens
  allele 24: 99-3620-314 : polymorphic base G or A
tagaagtctgccctgaccaccccrtccagagcagcgccatttccagt

SEQ ID NO: 3380 - DNA, 47 bp, Homo Sapiens
  allele 24: 99-3628-31 : polymorphic base G or A
taaacctcctactctggtgtccaraggacagatttctgtcccagagc

SEQ ID NO: 3381 - DNA, 47 bp, Homo Sapiens
  allele 24: 99-3629-219 : polymorphic base G or A
ttcactgggcattgcgcagtgcartctctccatggtggccctgcaca

SEQ ID NO: 3382 - DNA, 47 bp, Homo Sapiens
  allele 24: 99-3631-159 : polymorphic base C or T
ttttcaataatagagatgcaaagyggagcttagccaccttgaggcat

SEQ ID NO: 3383 - DNA, 47 bp, Homo Sapiens
  allele 24: 99-3638-259 : polymorphic base A or C
gccttttatatttctaaagatccmagatttgggcatctattcctgat

SEQ ID NO: 3384 - DNA, 47 bp, Homo Sapiens
  allele 24: 99-3641-230 : polymorphic base C or A
attcttcactttgcacacctagtmcttttctgtcttattcactgcta

SEQ ID NO: 3385 - DNA, 47 bp, Homo Sapiens
  allele 24: 99-3666-280 : polymorphic base G or A
ggacctggctgtccgcgaggcaargagtccatgcagactcgggtgtg

SEQ ID NO: 3386 - DNA, 47 bp, Homo Sapiens
  allele 24: 99-3667-190 : polymorphic base G or A
cggtcactcagggtggcagacacraaagggcaagagaatgagtcacc

SEQ ID NO: 3387 - DNA, 47 bp, Homo Sapiens
  allele 24: 99-3677-196 : polymorphic base T or A
cacccagcagtcggggggatggcwgaatgggcactggaaccaaagct

SEQ ID NO: 3388 - DNA, 47 bp, Homo Sapiens
  allele 24: 99-3680-274 : polymorphic base C or G
ccacatcaaaagggcaggaagtasagagcccctctgagggctggagg

SEQ ID NO: 3389 - DNA, 47 bp, Homo Sapiens
  allele 24: 99-3689-50 : polymorphic base A or G
ctacaagtttgtgccttaaaagcrggaattacgataaactctctttc

SEQ ID NO: 3390 - DNA, 47 bp, Homo Sapiens
  allele 24: 99-3690-355 : polymorphic base G or C
gcttaaaaataagggagtgggtgsaatgttatatagaccttttggct

SEQ ID NO: 3391 - DNA, 47 bp, Homo Sapiens
  allele 24: 99-3699-230 : polymorphic base G or A
tgctgtgaacaggaaacaagatgraggaggtgaaggtgaggagggtg

SEQ ID NO: 3392 - DNA, 47 bp, Homo Sapiens
  allele 24: 99-3702-226 : polymorphic base T or A
ccatcgtccgtcttcccaactagwctcaacccttgaggtcggggctt

SEQ ID NO: 3393 - DNA, 47 bp, Homo Sapiens
  allele 24: 99-3703-331 : polymorphic base C or T
atgaagaatacagaatatacatayatttataaaatgaatagacttaa

SEQ ID NO: 3394 - DNA, 47 bp, Homo Sapiens
  allele 24: 99-3705-195 : polymorphic base G or A
gttcctttgtaaatgcagaaatargtttaggataataaaggtattgt

SEQ ID NO: 3395 - DNA, 47 bp, Homo Sapiens
  allele 24: 99-3709-366 : polymorphic base T or C
ttatgttccaacaaaactttattyacaaatacagtcaacagactgga

SEQ ID NO: 3396 - DNA, 47 bp, Homo Sapiens
  allele 24: 99-3717-68 : polymorphic base A or G
acagcttctgaagccttcaattcrgatgcctctagggacagtagcat

SEQ ID NO: 3397 - DNA, 47 bp, Homo Sapiens
  allele 24: 99-3728-341 : polymorphic base T or C
ctttaaacttcagtaagatcttgyttacttgtctaagaaattcctac

SEQ ID NO: 3398 - DNA, 47 bp, Homo Sapiens
  allele 24: 99-3739-215 : polymorphic base G or A
atgtagttgctcttccttatgctrtcaccaggtaggaaaagtccagt

SEQ ID NO: 3399 - DNA, 47 bp, Homo Sapiens
  allele 24: 99-3746-337 : polymorphic base C or G
taaggaattcaaaatgaaattatstaggcatttccttttctcttttt

SEQ ID NO: 3400 - DNA, 47 bp, Homo Sapiens
  allele 24: 99-3749-174 : polymorphic base C or T
attttgggtctttgtcacgttggygattgagcctctaggtggaggca

SEQ ID NO: 3401 - DNA, 47 bp, Homo Sapiens
  allele 24: 99-3752-210 : polymorphic base C or T
tgtgctcttttaacactgcctaaygtcctttgatgcacaaaagtttc

SEQ ID NO: 3402 - DNA, 47 bp, Homo Sapiens
  allele 24: 99-3760-59 : polymorphic base A or G
ttgattgctkgttgcatttttccrtcattcttttgtctcccttcttg

SEQ ID NO: 3403 - DNA, 47 bp, Homo Sapiens
  allele 24: 99-3761-329 : polymorphic base C or T
gaccttggggaagtagctattatytatcaattgatttttacagagac

SEQ ID NO: 3404 - DNA, 47 bp, Homo Sapiens
  allele 24: 99-3764-198 : polymorphic base C or T
gcttttagattcataaaatgtgayaattaacaattcaacaggcatat

SEQ ID NO: 3405 - DNA, 47 bp, Homo Sapiens
  allele 24: 99-3765-279 : polymorphic base A or G
atgcaggaaactagaaatcagtarcaggagacattttttaaaataca

SEQ ID NO: 3406 - DNA, 47 bp, Homo Sapiens; identical to SEQ ID NO: 2498
  allele 24: 99-377-306 : polymorphic base G or A

SEQ ID NO: 3407 - DNA, 47 bp, Homo Sapiens
  allele 24: 99-3773-337 : polymorphic base T or C
caaaatgttttgggatggtagtcyagaatttcacctattaaaattac

SEQ ID NO: 3408 - DNA, 47 bp, Homo Sapiens
  allele 24: 99-3774-351 : polymorphic base A or G
aaaaaaaagtagttgggaaacccrtgacaataaggatctgaaattaa

SEQ ID NO: 3409 - DNA, 47 bp, Homo Sapiens
  allele 24: 99-3775-98 : polymorphic base G or A
attttaatgttgttcaattatttrttcatataagacttgcttaacat

SEQ ID NO: 3410 - DNA, 47 bp, Homo Sapiens
  allele 24: 99-3778-97 : polymorphic base T or A
tatttctgtttgagagaataaggwtgtatttttgtttactggattat

SEQ ID NO: 3411 - DNA, 47 bp, Homo Sapiens
  allele 24: 99-3789-293 : polymorphic base A or G
tttcagcactttgactgtggtatrcctaggtatgattttcattttat

SEQ ID NO: 3412 - DNA, 47 bp, Homo Sapiens
  allele 24: 99-3792-294 : polymorphic base A or G
gtacactccagcctggatgacagrgccaggctccatctcaaaaaaaa

SEQ ID NO: 3413 - DNA, 47 bp, Homo Sapiens
  allele 24: 99-3802-197 : polymorphic base C or T
tattttcttctcttaacgtgtctyttctgttaactttcctggataag

SEQ ID NO: 3414 - DNA, 47 bp, Homo Sapiens
  allele 24: 99-3805-125 : polymorphic base A or G
atgtgcagtgaagcctgttttcartgaatgcacccttcagttacagt

SEQ ID NO: 3415 - DNA, 47 bp, Homo Sapiens
  allele 24: 99-3812-243 : polymorphic base T or G
aaaccgattgcaaatgttcatccktaaaaaccattctcagctcctag

SEQ ID NO: 3416 - DNA, 47 bp, Homo Sapiens
  allele 24: 99-3813-122 : polymorphic base T or C
  misc_feature 29: n=a, g, c or t
tggaaggcgtctgtcggtgtctcyagctnccagcacaattcttaatc

SEQ ID NO: 3417 - DNA, 47 bp, Homo Sapiens
  allele 24: 99-3857-261 : polymorphic base A or G
gatgtgcctgactttagtatgatrtttaagagaaaagggcagtggaa

SEQ ID NO: 3418 - DNA, 47 bp, Homo Sapiens
  allele 24: 99-3862-153 : polymorphic base A or G
cagctcatcaacttggtgtggacrgcaatttccgctgcaaatttgag

SEQ ID NO: 3419 - DNA, 47 bp, Homo Sapiens
  allele 24: 99-3875-138 : polymorphic base A or C
atcacggaagatgacattcatttmgattcactttagatttcagggct

SEQ ID NO: 3420 - DNA, 47 bp, Homo Sapiens
  allele 24: 99-3888-309 : polymorphic base G or A
aaattaccttgtttgattatctarcttatttcttctctgcttcccct

SEQ ID NO: 3421 - DNA, 47 bp, Homo Sapiens
  allele 24: 99-3893-108 : polymorphic base A or C
aggccagccagttcagggacaggmctcgcagcccaggaaggattcca

SEQ ID NO: 3422 - DNA, 47 bp, Homo Sapiens
  allele 24: 99-3941-107 : polymorphic base A or G
tttccctgtctgcacagttggagrgttcaacagatgtcccccagttc

SEQ ID NO: 3423 - DNA, 47 bp, Homo Sapiens
  allele 24: 99-3944-247 : polymorphic base G or T
ggtcagctttggcagaacaaccckcaggtctaaggacatcgttttct

SEQ ID NO: 3424 - DNA, 47 bp, Homo Sapiens
  allele 24: 99-3953-77 : polymorphic base G or A
actggagccaggccagcagggacraatctcagctgggtcatttgcta

SEQ ID NO: 3425 - DNA, 47 bp, Homo Sapiens
  allele 24: 99-3954-362 : polymorphic base G or C
cacgcgcagtatcccgattggctstgccctagcggattgacgggcag

SEQ ID NO: 3426 - DNA, 47 bp, Homo Sapiens
  allele 24: 99-3978-146 : polymorphic base C or T
ctttgcacgaaggcattgccttcygaggtgggctacaccgacctcat

SEQ ID NO: 3427 - DNA, 47 bp, Homo Sapiens
  allele 24: 99-3981-156 : polymorphic base A or G
tgtaataaccataaagggggcttrgctcctcttgcatcgtgtatgca

SEQ ID NO: 3428 - DNA, 47 bp, Homo Sapiens
  allele 24: 99-3992-185 : polymorphic base C or T
gcttgagcccagaagttcaatacygcagcaagctatgatcgtgccac

SEQ ID NO: 3429 - DNA, 47 bp, Homo Sapiens
  allele 24: 99-4001-330 : polymorphic base C or T
cctcggagctggcggagcctagaygaggctgagcatagagggcttcc

SEQ ID NO: 3430 - DNA, 47 bp, Homo Sapiens
  allele 24: 99-4009-232 : polymorphic base C or T
agaatcctctagtggcttcccacytctctcagagtaaaatgcaaagt

SEQ ID NO: 3431 - DNA, 47 bp, Homo Sapiens
  allele 24: 99-4025-300 : polymorphic base C or T
gacttacaccccttgtaccaagcygaatgcagcttattgaagcaaga

SEQ ID NO: 3432 - DNA, 47 bp, Homo Sapiens
  allele 24: 99-4052-415 : polymorphic base G or T
aaattgaaaggctgagattgtaaktaacacctgactgcaattgatgc

SEQ ID NO: 3433 - DNA, 47 bp, Homo Sapiens
  allele 24: 99-4064-346 : polymorphic base A or C
tttaatcctccatcttcagctcamagccacactcctctgtgaacagt

SEQ ID NO: 3434 - DNA, 43 bp, Homo Sapiens
  allele 20: 99-4065-20 : polymorphic base A or G
cattatctcattgctgttcrtaattgttagattaattttgtaa

SEQ ID NO: 3435 - DNA, 47 bp, Homo Sapiens
  allele 24: 99-4073-307 : polymorphic base C or A
aatttggtagagcaaggactatgmataatggaaggccacttaccatt

SEQ ID NO: 3436 - DNA, 47 bp, Homo Sapiens
  allele 24: 99-4076-255 : polymorphic base G or A
agccgaatccactttttattgacragaagcctgggtcccagagacat

SEQ ID NO: 3437 - DNA, 47 bp, Homo Sapiens
  allele 24: 99-4077-230 : polymorphic base T or C
cgcatcctggctgagcacctttgytggtgtggagggactccctccag

SEQ ID NO: 3438 - DNA, 47 bp, Homo Sapiens
  allele 24: 99-4078-212 : polymorphic base G or C
ccgagccaccggatgtttgatctscttttacctttgtaaataaatac

SEQ ID NO: 3439 - DNA, 47 bp, Homo Sapiens
  allele 24: 99-4079-389 : polymorphic base A or G
caggtgtgcaaggtgcaaggaccrttcctgacatcaagacggtaacg

SEQ ID NO: 3440 - DNA, 47 bp, Homo Sapiens
  allele 24: 99-4119-307 : polymorphic base C or T
gatttcaatcatgatactgtgctygttttgaggaaatacaccctgaa

SEQ ID NO: 3441 - DNA, 47 bp, Homo Sapiens
  allele 24: 99-4120-253 : polymorphic base C or T
ctgggtgatcttctgaaagaagaytggataaattcttaggaccctaa

SEQ ID NO: 3442 - DNA, 46 bp, Homo Sapiens
  allele 23: 99-4122-23 : polymorphic base T or C
tatagataggtcacccactccayccagctgggtgtggggaggagcc

SEQ ID NO: 3443 - DNA, 47 bp, Homo Sapiens
  allele 24: 99-4125-192 : polymorphic base C or A
gctgccgccccaggtacagaccgmgatgtagaagacactaattgcac

SEQ ID NO: 3444 - DNA, 47 bp, Homo Sapiens
  allele 24: 99-4131-288 : polymorphic base T or C
ctttatgaattctaacatctgtayactgagattaagttgtgtatggt

SEQ ID NO: 3445 - DNA, 47 bp, Homo Sapiens
  allele 24: 99-4138-360 : polymorphic base A or C
agaaggggactgatcacagggggmgttagcagaggcaggacagacac

SEQ ID NO: 3446 - DNA, 47 bp, Homo Sapiens
  allele 24: 99-4139-128 : polymorphic base C or T
gcaaaacagtgtccccgccctcayggaaactctcaaacaagtgacag

SEQ ID NO: 3447 - DNA, 47 bp, Homo Sapiens
  allele 24: 99-4140-254 : polymorphic base C or T
tccgcagccttgtggggggagtaygagctctgcattgcatcttttca

SEQ ID NO: 3448 - DNA, 47 bp, Homo Sapiens
  allele 24: 99-4182-113 : polymorphic base A or G
gttatttgtaaatattggttttgrtgctaacctagaattccatcaaa

SEQ ID NO: 3449 - DNA, 47 bp, Homo Sapiens
  allele 24: 99-4193-384 : polymorphic base A or G
agcagttgtattttggagcccacrtgaaaggaaactatacttacatc

SEQ ID NO: 3450 - DNA, 47 bp, Homo Sapiens
  allele 24: 99-4194-336 : polymorphic base T or C
tgtggcctgcaatggtgcattccyggggctcaagaagtgatctgttt

SEQ ID NO: 3451 - DNA, 47 bp, Homo Sapiens
  allele 24: 99-4199-339 : polymorphic base G or A
agcaaaaggcttgcttaccatatrtgatgttctcttgtcacattcag

SEQ ID NO: 3452 - DNA, 47 bp, Homo Sapiens
  allele 24: 99-4201-501 : polymorphic base G or T
ttgcttagggtgtttttcactttktaagtgaccctgagatgaacgtc

SEQ ID NO: 3453 - DNA, 47 bp, Homo Sapiens
  allele 24: 99-4202-223 : polymorphic base T or C
attttcagcttatgagtctctgcyctggtaagttgtgattgtctgtc

SEQ ID NO: 3454 - DNA, 47 bp, Homo Sapiens
  allele 24: 99-4203-110 : polymorphic base T or C
ctggtttatttcacttaacagaaygtcttccagttccatccatgttg

SEQ ID NO: 3455 - DNA, 47 bp, Homo Sapiens
  allele 24: 99-4207-210 : polymorphic base G or A
tcacagcccagcaactgccattcrccttcacgattccccggagtttg

SEQ ID NO: 3456 - DNA, 47 bp, Homo Sapiens
  allele 24: 99-4218-24 : polymorphic base G or A
ataacaaaccccaaaccggaaacraccgaaatgctcatcgacaggcg

SEQ ID NO: 3457 - DNA, 47 bp, Homo Sapiens
  allele 24: 99-4220-241 : polymorphic base T or C
tctggccgctacttgcagctcggytaaatagcattcgcatcatttgc

SEQ ID NO: 3458 - DNA, 47 bp, Homo Sapiens
  allele 24: 99-4225-339 : polymorphic base T or C
tgaggtgggcagattgcttgagcycaggagttcaagaccagcctggg

SEQ ID NO: 3459 - DNA, 47 bp, Homo Sapiens
  allele 24: 99-4231-139 : polymorphic base T or C
cactgtgtgagcctagggctccayatccaatgtcatgctcattctgg

SEQ ID NO: 3460 - DNA, 47 bp, Homo Sapiens
  allele 24: 99-4232-105 : polymorphic base A or G
tccagtgggatttgggtgcttcartgtgcagggttagagagagggaa

SEQ ID NO: 3461 - DNA, 47 bp, Homo Sapiens
  allele 24: 99-4233-261 : polymorphic base A or G
attggccctgcaaggcctccagcrctgggcaccacacacgtgatgct

SEQ ID NO: 3462 - DNA, 47 bp, Homo Sapiens
  allele 24: 99-4238-181 : polymorphic base T or C
taaaagagggcattttatcttttytatttttttcattttacatgtct

SEQ ID NO: 3463 - DNA, 47 bp, Homo Sapiens
  allele 24: 99-4251-311 : polymorphic base T or C
tgctattgttgaactgaaattgcycctttccttgtttagataagtgg

SEQ ID NO: 3464 - DNA, 47 bp, Homo Sapiens
  allele 24: 99-4266-313 : polymorphic base A or G
ggttcctctccagtgtcctcctaratgtggacacgaagtctaacaga

SEQ ID NO: 3465 - DNA, 47 bp, Homo Sapiens
  allele 24: 99-4272-418 : polymorphic base G or A
cggggcgccacggatcagtcattratccaggttgatgatggagaccc

SEQ ID NO: 3466 - DNA, 47 bp, Homo Sapiens
  allele 24: 99-4283-257 : polymorphic base G or A
cttatcacaaagatcaagacctcrtgatacacacccacgcctactcc

SEQ ID NO: 3467 - DNA, 47 bp, Homo Sapiens
  allele 24: 99-4284-200 : polymorphic base A or C
tggtctttctccatcccaacttamgtatgaaagagaggagaggagaa

SEQ ID NO: 3468 - DNA, 47 bp, Homo Sapiens
  allele 24: 99-4285-370 : polymorphic base C or T
attcagtaaaaccagctttttatycgtagtttacttcctgctgcatc

SEQ ID NO: 3469 - DNA, 47 bp, Homo Sapiens
  allele 24: 99-4290-131 : polymorphic base G or A
tgatgtaaaatgtatttcttatartgcatcgtagtcagaataagtct

SEQ ID NO: 3470 - DNA, 47 bp, Homo Sapiens
  allele 24: 99-4293-344 : polymorphic base C or T
ggcttcccaaaggggataaggagyaatgggggagaaatgcctcagga

SEQ ID NO: 3471 - DNA, 47 bp, Homo Sapiens
  allele 24: 99-4296-156 : polymorphic base T or A
atgtgagggtttaggggctgggcwggggccatcggagggcagagctg

SEQ ID NO: 3472 - DNA, 47 bp, Homo Sapiens
  allele 24: 99-4312-338 : polymorphic base A or G
ctcagttttctcacttgtaaaatrgaggacagttttctagagatctg

SEQ ID NO: 3473 - DNA, 47 bp, Homo Sapiens
  allele 24: 99-4323-311 : polymorphic base T or C
agagaaatgagaatgcattttgayaagaaggaatgactaaggtggaa

SEQ ID NO: 3474 - DNA, 47 bp, Homo Sapiens
  allele 24: 99-4325-87 : polymorphic base T or C
actggtaagacctcacaaacaccytgcccgggttcaggcttcactag

SEQ ID NO: 3475 - DNA, 47 bp, Homo Sapiens
  allele 24: 99-4332-136 : polymorphic base C or A
taggcagatgtcgctaattaactmtgacatgttctcctgcagggcat

SEQ ID NO: 3476 - DNA, 47 bp, Homo Sapiens
  allele 24: 99-4335-371 : polymorphic base C or G
atttaaaaaagctatctaccgttstagaatcactgtcgttgtttaya

SEQ ID NO: 3477 - DNA, 47 bp, Homo Sapiens
  allele 24: 99-4336-171 : polymorphic base C or T
aacataggttactgatttgagatyttttaaaaatacaggtacttaag

SEQ ID NO: 3478 - DNA, 47 bp, Homo Sapiens
  allele 24: 99-4337-369 : polymorphic base A or G
atcaatgctaaaagaccaaaaacraaggagccattttgtcagtctaa

SEQ ID NO: 3479 - DNA, 47 bp, Homo Sapiens
  allele 24: 99-4339-180 : polymorphic base T or C
tgagtgaaatcaacagaaataaaygcaagccatttaaattttatccc

SEQ ID NO: 3480 - DNA, 47 bp, Homo Sapiens
  allele 24: 99-4358-133 : polymorphic base A or G
catatctctatctcccttatcacrattatagtaatttaatgtaaccc

SEQ ID NO: 3481 - DNA, 47 bp, Homo Sapiens
  allele 24: 99-4364-360 : polymorphic base C or T
atccatacctttccactagtgtgytgcacaatgagactgagaaaaat

SEQ ID NO: 3482 - DNA, 47 bp, Homo Sapiens
  allele 24: 99-4398-167 : polymorphic base T or A
gtattaaatataaaaatatatatwtttttaactacaatatttatatt

SEQ ID NO: 3483 - DNA, 47 bp, Homo Sapiens
  allele 24: 99-4399-228 : polymorphic base T or A
atgataggcaactaatagtgccawtaagtaaaaactacaatggtatg

SEQ ID NO: 3484 - DNA, 47 bp, Homo Sapiens
  allele 24: 99-4404-384 : polymorphic base G or A
ctccagccttactctctgtgccartggtgggaacagtaagtaaagac

SEQ ID NO: 3485 - DNA, 47 bp, Homo Sapiens
  allele 24: 99-4406-115 : polymorphic base A or G
gtattatagattataaatggtttrtcattgtcactgaaggcacgttg

SEQ ID NO: 3486 - DNA, 47 bp, Homo Sapiens
  allele 24: 99-4435-203 : polymorphic base A or G
gttcagttggctttttccatatcrccagtgacatctttcttcttcct

SEQ ID NO: 3487 - DNA, 47 bp, Homo Sapiens
  allele 24: 99-4448-174 : polymorphic base T or C
gagaaggttttactttttgagacygagtcttcctctgtcgcccaggc

SEQ ID NO: 3488 - DNA, 47 bp, Homo Sapiens
  allele 24: 99-4455-357 : polymorphic base T or A
tcccctctgcctggagtgctgtgwcttctccagaaacacgtgttgtt

SEQ ID NO: 3489 - DNA, 47 bp, Homo Sapiens
  allele 24: 99-4458-59 : polymorphic base A or G
gagtgtatatatatatttttttcrtagatgtcatgaactgacattac

SEQ ID NO: 3490 - DNA, 47 bp, Homo Sapiens
  allele 24: 99-4467-39 : polymorphic base T or C
ctgcagttcctttgagttaaactyctcaatactttaaccacaccatg

SEQ ID NO: 3491 - DNA, 47 bp, Homo Sapiens
  allele 24: 99-4468-130 : polymorphic base C or A
tttacagagtaggcacaatacttmagcaaaatattacgtgtattaga

SEQ ID NO: 3492 - DNA, 47 bp, Homo Sapiens
  allele 24: 99-4483-333 : polymorphic base C or T
gtcttttgtacaattcccacttaygagaaattaccttagaatttagt

SEQ ID NO: 3493 - DNA, 47 bp, Homo Sapiens
  allele 24: 99-4534-158 : polymorphic base T or C
ataaacttggatttcttgatttcytcccaggtgttagtagaaacctt

SEQ ID NO: 3494 - DNA, 47 bp, Homo Sapiens
  allele 24: 99-4567-424 : polymorphic base T or C
tgggtgcggggcctggagcgggtyagggcccaggagccccagatgca

SEQ ID NO: 3495 - DNA, 47 bp, Homo Sapiens
  allele 24: 99-4575-226 : polymorphic base C or T
ataaagttagaggactcacacttyccatctgtgaacttactacagag

SEQ ID NO: 3496 - DNA, 47 bp, Homo Sapiens
  allele 24: 99-4580-296 : polymorphic base G or A
ccatctctggccttcaacataggrtttgggtctttcctgggtgagct

SEQ ID NO: 3497 - DNA, 47 bp, Homo Sapiens
  allele 24: 99-4589-169 : polymorphic base C or T
ccttgggtattccttcctcacaaytcacttcgggaaacgctgattta

SEQ ID NO: 3498 - DNA, 47 bp, Homo Sapiens
  allele 24: 99-4614-72 : polymorphic base A or C
acagattgagagctttcctcagcmtttccgcccagcagggtccggaa

SEQ ID NO: 3499 - DNA, 47 bp, Homo Sapiens
  allele 24: 99-4619-267 : polymorphic base A or C
tgctttagaagcaattagttttgmtttggcaaacaaattcattattt

SEQ ID NO: 3500 - DNA, 47 bp, Homo Sapiens
  allele 24: 99-4636-62 : polymorphic base C or T
cttgacttatttccttcacaacayttatcattaactgaaaatagatg

SEQ ID NO: 3501 - DNA, 47 bp, Homo Sapiens
  allele 24: 99-4649-251 : polymorphic base T or A
ctggggcagggcttgtgagctgcwgtttacacaggtttattggcaag

SEQ ID NO: 3502 - DNA, 47 bp, Homo Sapiens
  allele 24: 99-468-271 : polymorphic base T or C
gctagcaagtagtcaagagctagyctagtttgatagatagcatttct

SEQ ID NO: 3503 - DNA, 47 bp, Homo Sapiens
  allele 24: 99-4688-442 : polymorphic base C or G
cacagacacagagagacatatgtsgggctgagctggaagctggatgg

SEQ ID NO: 3504 - DNA, 47 bp, Homo Sapiens
  allele 24: 99-4691-400 : polymorphic base A or G
agctgcctgatttccttatgagartgtcacttgtgacggagcataat

SEQ ID NO: 3505 - DNA, 47 bp, Homo Sapiens
  allele 24: 99-4692-372 : polymorphic base T or G
cagagagctcagagcaatcatcakgcatggacttccaggtcctagta

SEQ ID NO: 3506 - DNA, 47 bp, Homo Sapiens
  allele 24: 99-4715-280 : polymorphic base G or A
aaccagaattgttctgaaaaatcrtatttgaatgctattttagggag

SEQ ID NO: 3507 - DNA, 47 bp, Homo Sapiens
  allele 24: 99-4736-164 : polymorphic base C or T
gtgtcccccacccccaaaagataygctgaaatcttaatccctggtac

SEQ ID NO: 3508 - DNA, 47 bp, Homo Sapiens
  allele 24: 99-4744-72 : polymorphic base G or T
gakyaccctcatgattgagtgackgattgggagctgccaccgcctag

SEQ ID NO: 3509 - DNA, 47 bp, Homo Sapiens
  allele 24: 99-4746-160 : polymorphic base G or T
gggtgtgtttatgccagcagaggkcaccatgaggcccagacctcacc

SEQ ID NO: 3510 - DNA, 47 bp, Homo Sapiens
  allele 24: 99-4748-76 : polymorphic base C or T
actaacccagcctcttgattttcytacctgaggggagatgtctgatt

SEQ ID NO: 3511 - DNA, 47 bp, Homo Sapiens
  allele 24: 99-4755-84 : polymorphic base C or A
tcattgaattcacctaatactgcmttttaaaatgacaaaaaatgaat

SEQ ID NO: 3512 - DNA, 47 bp, Homo Sapiens
  allele 24: 99-4758-66 : polymorphic base G or A
gtggcagtggctttaatttcaggraatcaggtccctagtatgtcagt

SEQ ID NO: 3513 - DNA, 47 bp, Homo Sapiens
  allele 24: 99-4772-80 : polymorphic base C or A
tgtaatgtgaactaagttttttcmattcctaattagagatggtagtt

SEQ ID NO: 3514 - DNA, 47 bp, Homo Sapiens
  allele 24: 99-4791-198 : polymorphic base G or A
tagccttaagaaattgcccctgarggaaatggagcaagatgattgtt

SEQ ID NO: 3515 - DNA, 47 bp, Homo Sapiens
  allele 24: 99-4792-298 : polymorphic base G or A
caagaaacattaaaaaaaaagtcrgtccccaaggtacacagcaattt

SEQ ID NO: 3516 - DNA, 47 bp, Homo Sapiens
  allele 24: 99-4799-209 : polymorphic base C or A
agggtaactatgtgagctgatggmtatattaatgagcttgatcacag

SEQ ID NO: 3517 - DNA, 47 bp, Homo Sapiens
  allele 24: 99-480-373 : polymorphic base G or A
caacaaattttccctctagaaagraaccaactgaattctttgttttt

SEQ ID NO: 3518 - DNA, 47 bp, Homo Sapiens
  allele 24: 99-4810-454 : polymorphic base A or G
ttttaacacagtattgagtatcartacattcaacacagactcaaaag

SEQ ID NO: 3519 - DNA, 47 bp, Homo Sapiens
  allele 24: 99-4825-253 : polymorphic base A or G
agcagtgggagaccccatttaatrgatctacaattaaatatgttctt

SEQ ID NO: 3520 - DNA, 47 bp, Homo Sapiens
  allele 24: 99-4832-314 : polymorphic base G or A
taattgaggtgatccatcaagagrcccattctggataatgaaaaatt

SEQ ID NO: 3521 - DNA, 47 bp, Homo Sapiens; identical to SEQ ID NO: 3374
  allele 24: 99-4837-337 : polymorphic base C or T

SEQ ID NO: 3522 - DNA, 47 bp, Homo Sapiens
  allele 24: 99-4856-363 : polymorphic base G or A
gagtcattgttaaaaaaattctgrctgttcaatattcccacaaaatt

SEQ ID NO: 3523 - DNA, 47 bp, Homo Sapiens
  allele 24: 99-4871-375 : polymorphic base C or T
aggaaaggcaaaactgagtctccyctgcattcctacaccgcaaacca

SEQ ID NO: 3524 - DNA, 47 bp, Homo Sapiens
  allele 24: 99-4874-285 : polymorphic base C or T
agggtcccctggcactctgggccytgggtccttccccagccctaggt

SEQ ID NO: 3525 - DNA, 47 bp, Homo Sapiens
  allele 24: 99-4885-366 : polymorphic base A or G
aggaggactggatgttccactagrtgaaagctttcagatgttaatga

SEQ ID NO: 3526 - DNA, 47 bp, Homo Sapiens
  allele 24: 99-49-41 : polymorphic base G or A
gcaactcaaattaggaagaactgragcccgcaatgagtagagcattt

SEQ ID NO: 3527 - DNA, 47 bp, Homo Sapiens
  allele 24: 99-4903-395 : polymorphic base A or G
ctatgcaaaacttttaggtttatrttcatctgctttattttaaaaaa

SEQ ID NO: 3528 - DNA, 47 bp, Homo Sapiens
  allele 24: 99-499-294 : polymorphic base C or T
ttctctatatactgatgaaaataytaaatgaacattgggggaaaata

SEQ ID NO: 3529 - DNA, 47 bp, Homo Sapiens
  allele 24: 99-5059-256 : polymorphic base T or C
ggccatgctccccctcactgggcygtgctgcacctggccacctctgc

SEQ ID NO: 3530 - DNA, 47 bp, Homo Sapiens
  allele 24: 99-5074-454 : polymorphic base T or C
atagatgtgcccagagcactttgyttatttcatggaaaaaaaatgaa

SEQ ID NO: 3531 - DNA, 47 bp, Homo Sapiens
  allele 24: 99-5076-173 : polymorphic base C or T
ggacatttactgattgtgtacgtygtgcaaggcatcagctgggttct

SEQ ID NO: 3532 - DNA, 47 bp, Homo Sapiens
  allele 24: 99-5098-29 : polymorphic base G or A
tcacctaacatcctttagtgcccrctcatagagacagagctcagtcc

SEQ ID NO: 3533 - DNA, 47 bp, Homo Sapiens
  allele 24: 99-51-263 : polymorphic base G or C
acacttttctttctaagacatttstggcataaatagctcctgctgac

SEQ ID NO: 3534 - DNA, 47 bp, Homo Sapiens
  allele 24: 99-5112-188 : polymorphic base C or T
gaaaatatgatacatatacaccayggaatactatgcagccataaaaa

SEQ ID NO: 3535 - DNA, 47 bp, Homo Sapiens
  allele 24: 99-515-151 : polymorphic base T or C
tgttgttgactcacaataaacaayacttccacaaaatctatgggctt

SEQ ID NO: 3536 - DNA, 47 bp, Homo Sapiens
  allele 24: 99-5166-223 : polymorphic base C or T
gtagtagggccaccgaacagagayagaggaaaccgcaaatctatctg

SEQ ID NO: 3537 - DNA, 47 bp, Homo Sapiens
  allele 24: 99-5167-321 : polymorphic base A or T
tcccatggatgaggtctccgaggwtgagcagagtaacttcccaaagg

SEQ ID NO: 3538 - DNA, 47 bp, Homo Sapiens
  allele 24: 99-5176-230 : polymorphic base T or C
ccagtgctcaccacacttacatayacacacttcctatggcatccttg

SEQ ID NO: 3539 - DNA, 47 bp, Homo Sapiens
  allele 24: 99-5240-419 : polymorphic base C or T
acatgacagacttatgggatctgyattaagtggctggtattatgact

SEQ ID NO: 3540 - DNA, 47 bp, Homo Sapiens
  allele 24: 99-5329-269 : polymorphic base G or T
tgtatatggtgagagatataatckaatttcatccttctgcatgggga

SEQ ID NO: 3541 - DNA, 47 bp, Homo Sapiens
  allele 24: 99-5339-196 : polymorphic base A or G
caaatatatccagaagtcactttrcatttttaatcaataagtgagta

SEQ ID NO: 3542 - DNA, 47 bp, Homo Sapiens
  allele 24: 99-5347-394 : polymorphic base T or C
cttgcctccttcactatgggcaaycttccaccctccattcctccttc

SEQ ID NO: 3543 - DNA, 47 bp, Homo Sapiens
  allele 24: 99-5397-353 : polymorphic base G or C
tgagagacgccttcaaaaaccctscataaaaagtagcaaccatcacc

SEQ ID NO: 3544 - DNA, 47 bp, Homo Sapiens
  allele 24: 99-55-233 : polymorphic base C or A
ttaaaggagaacaactttatagamtagggttatcttctgaaagagaa

SEQ ID NO: 3545 - DNA, 47 bp, Homo Sapiens
  allele 24: 99-5549-289 : polymorphic base A or G
ttggttagctatgctatgtttacrcccaatgaaaggctttcgtctcc

SEQ ID NO: 3546 - DNA, 47 bp, Homo Sapiens
  allele 24: 99-5569-237 : polymorphic base A or G
actgcctccccaaacccatgggaractgggtttgattctggctctgc

SEQ ID NO: 3547 - DNA, 47 bp, Homo Sapiens
  allele 24: 99-5575-330 : polymorphic base C or T
tgagggagagactgaattctttcytgaaacagaaatattcctatctc

SEQ ID NO: 3548 - DNA, 47 bp, Homo Sapiens
  allele 24: 99-5602-372 : polymorphic base G or C
gacagtggcttctccaggtgtaastgttgaggaggctgtggagcaaa

SEQ ID NO: 3549 - DNA, 47 bp, Homo Sapiens
  allele 24: 99-5671-333 : polymorphic base T or C
aagctataaagcgtgggttacagygtctggtgaggcactattaggtt

SEQ ID NO: 3550 - DNA, 47 bp, Homo Sapiens
  allele 24: 99-568-101 : polymorphic base G or A
agaggtaacatatatgagtccatrgtatctgttaatttatatgtcag

SEQ ID NO: 3551 - DNA, 47 bp, Homo Sapiens
  allele 24: 99-5688-116 : polymorphic base A or G
ggcagagtggagaggagccaatargtgtcctggacaattgcggtgtc

SEQ ID NO: 3552 - DNA, 47 bp, Homo Sapiens
  allele 24: 99-5689-391 : polymorphic base G or C
atttatttcacaataggagtgacsctgtgcaggaacatatgggctag

SEQ ID NO: 3553 - DNA, 47 bp, Homo Sapiens
  allele 24: 99-5715-224 : polymorphic base T or G
tttttaagcttctgatgcccatgkcccacccagggcttgaatttatt

SEQ ID NO: 3554 - DNA, 47 bp, Homo Sapiens
  allele 24: 99-5718-82 : polymorphic base A or G
cctggaagggtggaaagcaatagrgtgcggagaatcaggtggtttgt

SEQ ID NO: 3555 - DNA, 47 bp, Homo Sapiens
  allele 24: 99-5723-291 : polymorphic base A or G
gggactgaaaggggtagagggtcrtgccaaaatgagaaagcagggcc

SEQ ID NO: 3556 - DNA, 47 bp, Homo Sapiens
  allele 24: 99-5747-278 : polymorphic base T or C
aagtgcctggcacccggtaaacaygctgcaaatgtactattgtcatc

SEQ ID NO: 3557 - DNA, 47 bp, Homo Sapiens
  allele 24: 99-5775-154 : polymorphic base C or T
ttaaacaaattatgctgaaacaaytgaatattcacatggggacaaaa

SEQ ID NO: 3558 - DNA, 47 bp, Homo Sapiens
  allele 24: 99-5828-235 : polymorphic base T or C
gaagcatgatggtctgaggaaagyagtcagctccagccataattaat

SEQ ID NO: 3559 - DNA, 47 bp, Homo Sapiens
  allele 24: 99-5846-383 : polymorphic base C or T
cttccagtcttctcacagagactyagatattttcttgtagtcgagaa

SEQ ID NO: 3560 - DNA, 47 bp, Homo Sapiens
  allele 24: 99-5861-151 : polymorphic base G or A
gacaacagccatagatggaacaarctataataaggcacatggtaggc

SEQ ID NO: 3561 - DNA, 47 bp, Homo Sapiens
  allele 24: 99-59-137 : polymorphic base A or C
ctagttttgcatgctgtgctttgmggagagaaggaagagggagtttt

SEQ ID NO: 3562 - DNA, 47 bp, Homo Sapiens
  allele 24: 99-5930-449 : polymorphic base T or A
agatggactcaataatatcaaagwcttttatgttgaatccttaacaa

SEQ ID NO: 3563 - DNA, 47 bp, Homo Sapiens
  allele 24: 99-5931-330 : polymorphic base G or A
cttggatccttaaggagtttacgraatctgctgttttatcaaagtga

SEQ ID NO: 3564 - DNA, 47 bp, Homo Sapiens
  allele 24: 99-5967-165 : polymorphic base C or T
aaatgtttgccaactgtagtctayacctttgcacgtcagagaattgc

SEQ ID NO: 3565 - DNA, 47 bp, Homo Sapiens
  allele 24: 99-5987-135 : polymorphic base A or G
acctggttggatttttggactccrtaactgaactaatcacaagtcac

SEQ ID NO: 3566 - DNA, 47 bp, Homo Sapiens
  allele 24: 99-5996-279 : polymorphic base T or C
ttaacatttttcactttatcttayagtatagttgtgtaaataacctc

SEQ ID NO: 3567 - DNA, 47 bp, Homo Sapiens
  allele 24: 99-6001-372 : polymorphic base T or G
taagcaacttctacatgttctagkattttttggtcatattttacttt

SEQ ID NO: 3568 - DNA, 47 bp, Homo Sapiens
  allele 24: 99-6020-477 : polymorphic base A or G
ggcttcctacccagatgaccttcrgaaaaatttctctgaatccctga

SEQ ID NO: 3569 - DNA, 47 bp, Homo Sapiens
  allele 24: 99-6047-225 : polymorphic base T or A
agtctagtgttcaggggaggcatwtgggctggagatatacatttggg

SEQ ID NO: 3570 - DNA, 47 bp, Homo Sapiens
  allele 24: 99-6071-272 : polymorphic base A or G
tcaagaataaggaataatgatatrtcaaggaagctaatattggcttt

SEQ ID NO: 3571 - DNA, 47 bp, Homo Sapiens
  allele 24: 99-6076-394 : polymorphic base A or T
tctgcctgcctttaccttgcaatwgatatgagaataaattcaaaatg

SEQ ID NO: 3572 - DNA, 47 bp, Homo Sapiens
  allele 24: 99-6096-354 : polymorphic base C or G
aagagtgacaaggtatttcaacasgtgaatgatgtgagtaaatattt

SEQ ID NO: 3573 - DNA, 47 bp, Homo Sapiens
  allele 24: 99-6103-356 : polymorphic base T or C
cctgtggatttttgaacttgccaycatcacataagccagtattttgc

SEQ ID NO: 3574 - DNA, 47 bp, Homo Sapiens
  allele 24: 99-6124-125 : polymorphic base T or C
tttggtacaacttcttttgtttgygaataagtagaataatccaacac

SEQ ID NO: 3575 - DNA, 47 bp, Homo Sapiens
  allele 24: 99-6173-229 : polymorphic base T or G
aaaccgatgtcaggcaagggcagkttggagaggaagaagtacatggg

SEQ ID NO: 3576 - DNA, 47 bp, Homo Sapiens
  allele 24: 99-634-278 : polymorphic base T or A
tcctctmtttctctaatatcctawaggaaatctaacagaaattcctg

SEQ ID NO: 3577 - DNA, 47 bp, Homo Sapiens
  allele 24: 99-6401-64 : polymorphic base A or G
accagggaccccagcatgaaccartgacacaacgctcagcccgtaga

SEQ ID NO: 3578 - DNA, 47 bp, Homo Sapiens
  allele 24: 99-6538-193 : polymorphic base G or A
agctccaagctgaccctgatgagrgcaatatgatcttggtggctctg

SEQ ID NO: 3579 - DNA, 47 bp, Homo Sapiens
  allele 24: 99-6549-275 : polymorphic base A or G
gtgtgagctgagttacaagccccrtgtttaaaggtgggtgcggtcac

SEQ ID NO: 3580 - DNA, 47 bp, Homo Sapiens
  allele 24: 99-6564-236 : polymorphic base G or C
tgaattgataccctcctcccttcstccacgattaatgaaactaatca

SEQ ID NO: 3581 - DNA, 47 bp, Homo Sapiens
  allele 24: 99-6574-150 : polymorphic base T or G
actttgtgtttagatttattggtkattacttcctgtcaccatcacca

SEQ ID NO: 3582 - DNA, 47 bp, Homo Sapiens
  allele 24: 99-6583-289 : polymorphic base A or G
caaatagacaattatgacgctcarccagattccttgtgaatgaacca

SEQ ID NO: 3583 - DNA, 47 bp, Homo Sapiens
  allele 24: 99-6591-236 : polymorphic base T or C
tcttccaacccatcccaatatttyttcttgcttaatctcaatctcaa

SEQ ID NO: 3584 - DNA, 47 bp, Homo Sapiens
  allele 24: 99-6597-213 : polymorphic base A or G
ttatagagaatcaaagaaatcatrcaatggacaaaagagcttctcag

SEQ ID NO: 3585 - DNA, 47 bp, Homo Sapiens
  allele 24: 99-6603-47 : polymorphic base A or G
aaaagcttgctgggctgctagtgrtcaactgttcaaaagtttccaaa

SEQ ID NO: 3586 - DNA, 47 bp, Homo Sapiens
  allele 24: 99-6707-405 : polymorphic base G or A
gcacatgggatttagggtcacagrgacttaggttgacactagattca

SEQ ID NO: 3587 - DNA, 47 bp, Homo Sapiens
  allele 24: 99-6720-186 : polymorphic base C or G
ggagggcctgcttctgagtaggtstaccccacttgaaaccatcctag

SEQ ID NO: 3588 - DNA, 47 bp, Homo Sapiens
  allele 24: 99-6809-317 : polymorphic base C or T
aagattcattaccatatctggctyctagatttcacttaatcatcaca

SEQ ID NO: 3589 - DNA, 47 bp, Homo Sapiens
  allele 24: 99-6834-307 : polymorphic base G or A
agtgaaagaaggaagacagtgctratgaggtgctacttcactgcacc

SEQ ID NO: 3590 - DNA, 47 bp, Homo Sapiens
  allele 24: 99-6837-253 : polymorphic base C or A
tgattgccttggagttgccttgamggaagagtgggagttggcccaac

SEQ ID NO: 3591 - DNA, 47 bp, Homo Sapiens
  allele 24: 99-6878-317 : polymorphic base C or T
tattccatcaggtaatgtaatgaygctgcagacacagtggcgaacaa

SEQ ID NO: 3592 - DNA, 47 bp, Homo Sapiens
  allele 24: 99-6888-188 : polymorphic base T or G
ctaatccccagtaggatggttttkggaagtgaggcctttgggaagca

SEQ ID NO: 3593 - DNA, 47 bp, Homo Sapiens
  allele 24: 99-6919-372 : polymorphic base G or A
attcagagaaggtagcaaaaatgrgctattccacaggctgcttcctg

SEQ ID NO: 3594 - DNA, 47 bp, Homo Sapiens
  allele 24: 99-6922-169 : polymorphic base T or C
attcagattgagattctagtcttyagtgacatggaatgtagattaga

SEQ ID NO: 3595 - DNA, 47 bp, Homo Sapiens
  allele 24: 99-6974-417 : polymorphic base A or G
agctgagtcacctacgggcaagcrggcagctgaagatgatgaggatg

SEQ ID NO: 3596 - DNA, 47 bp, Homo Sapiens
  allele 24: 99-6978-149 : polymorphic base C or G
tctgtgaggggcttgcaaagtgasagtctctatcaacaccttgatct

SEQ ID NO: 3597 - DNA, 47 bp, Homo Sapiens
  allele 24: 99-6984-287 : polymorphic base G or C
ctcagagaccactgagaatacaascaattaaatggggaaatacggga

SEQ ID NO: 3598 - DNA, 47 bp, Homo Sapiens
  allele 24: 99-6998-86 : polymorphic base T or C
taggaaacagcccagcctgggaayattgtcacaagcattaataggtc

SEQ ID NO: 3599 - DNA, 47 bp, Homo Sapiens
  allele 24: 99-7032-416 : polymorphic base T or A
atgaggacaacagatcctggcttwatagagaacataaagtaataaag

SEQ ID NO: 3600 - DNA, 47 bp, Homo Sapiens
  allele 24: 99-7048-342 : polymorphic base C or T
agcagataatcaatttatgccctycaaattacccattgtgagaacca

SEQ ID NO: 3601 - DNA, 47 bp, Homo Sapiens
  allele 24: 99-7060-512 : polymorphic base A or G
attatcaaagctaggttggcttcrtaatattttctgacagaatcatc

SEQ ID NO: 3602 - DNA, 47 bp, Homo Sapiens
  allele 24: 99-7086-91 : polymorphic base G or C
ccctgggaaggcggcttcagtgcscgcttccctgagcaaaggctcgt

SEQ ID NO: 3603 - DNA, 47 bp, Homo Sapiens
  allele 24: 99-7117-266 : polymorphic base T or A
catcaagggaatgggtactgttcwaaaaggaatgccccacaagtgtt

SEQ ID NO: 3604 - DNA, 47 bp, Homo Sapiens
  allele 24: 99-7203-286 : polymorphic base T or C
tagatttttcttaaaaaaattttyttttattcttgagtacttggttt

SEQ ID NO: 3605 - DNA, 47 bp, Homo Sapiens
  allele 24: 99-7268-383 : polymorphic base T or C
ctttcccctctgtctctgctactyccaaatctcagactttcttctaa

SEQ ID NO: 3606 - DNA, 47 bp, Homo Sapiens
  allele 24: 99-7281-131 : polymorphic base T or C
cacaatggttctaggctctctgcytgccttctcaccatttctagtgg

SEQ ID NO: 3607 - DNA, 47 bp, Homo Sapiens
  allele 24: 99-7282-145 : polymorphic base G or T
tttcttgagagttcaaactttggktctgttcctgaatatgtcacttt

SEQ ID NO: 3608 - DNA, 47 bp, Homo Sapiens
  allele 24: 99-7296-429 : polymorphic base T or C
aggagcgagaggagactccctctycgaactaatttaggttagtggag

SEQ ID NO: 3609 - DNA, 47 bp, Homo Sapiens
  allele 24: 99-7344-203 : polymorphic base C or T
tttggccagactggattagttccygtgggaatgaattagttcctgtg

SEQ ID NO: 3610 - DNA, 47 bp, Homo Sapiens
  allele 24: 99-7377-370 : polymorphic base T or C
tgaacatagcagcaatgaagtaayatggaaggtcacagagttaatga

SEQ ID NO: 3611 - DNA, 47 bp, Homo Sapiens
  allele 24: 99-7394-398 : polymorphic base A or G
ctagctaaatatatatacagatargtagctggatatagacatatatc

SEQ ID NO: 3612 - DNA, 47 bp, Homo Sapiens
  allele 24: 99-7412-288 : polymorphic base C or T
taacgagtgtccactttgcaagaytcctagagtttattttggtttcc

SEQ ID NO: 3613 - DNA, 47 bp, Homo Sapiens
  allele 24: 99-7422-375 : polymorphic base C or T
ccctcaaagtgaacagagtctctyccaatacaaagccttgcactgat

SEQ ID NO: 3614 - DNA, 47 bp, Homo Sapiens
  allele 24: 99-7430-548 : polymorphic base T or A
cctcatgttcaagcacacatctgwtagaagcaagacattctgccacc

SEQ ID NO: 3615 - DNA, 47 bp, Homo Sapiens
  allele 24: 99-7442-390 : polymorphic base T or C
aactttgggtggcaatagagtaaytacagactaagagaaaaaaaaat

SEQ ID NO: 3616 - DNA, 47 bp, Homo Sapiens
  allele 24: 99-7481-268 : polymorphic base A or G
tatagagatgaaggcttagctgargctggaaaccataaatgtgaagt

SEQ ID NO: 3617 - DNA, 47 bp, Homo Sapiens
  allele 24: 99-7696-215 : polymorphic base C or T
gaaactttatgttatgttatgcaygttaggtgttagaagatactcag

SEQ ID NO: 3618 - DNA, 47 bp, Homo Sapiens
  allele 24: 99-7702-225 : polymorphic base C or T
tctgttcttggtgggggtttggayacctttggttgctctgaacccag

SEQ ID NO: 3619 - DNA, 47 bp, Homo Sapiens
  allele 24: 99-7772-185 : polymorphic base C or T
tcctcttcctcctgcctctggctyaccaacagataatctctacgctt

SEQ ID NO: 3620 - DNA, 47 bp, Homo Sapiens
  allele 24: 99-7815-70 : polymorphic base A or T
ctgccttcaccccatccttggttwcctgggctgtccagtaacgagcc

SEQ ID NO: 3621 - DNA, 47 bp, Homo Sapiens
  allele 24: 99-7818-342 : polymorphic base G or A
aaatctgcttatcaccgctatcgrcaataaaaattagtggagcctta

SEQ ID NO: 3622 - DNA, 47 bp, Homo Sapiens
  allele 24: 99-7860-320 : polymorphic base T or G
agcacattttcgacacttttgctkgaaggtaaaacattgtgcctagc

SEQ ID NO: 3623 - DNA, 47 bp, Homo Sapiens
  allele 24: 99-7886-350 : polymorphic base G or C
tgcagctggagacaaaatggttasaaggacctggagccttcttgctg

SEQ ID NO: 3624 - DNA, 47 bp, Homo Sapiens
  allele 24: 99-7944-130 : polymorphic base A or T
tctcagaggaggtaataccagagwctcgccacaggcaaccaacctga

SEQ ID NO: 3625 - DNA, 47 bp, Homo Sapiens
  allele 24: 99-7945-106 : polymorphic base G or A
acttagcagggacctctttccccrctcagagtggatagagacaagaa

SEQ ID NO: 3626 - DNA, 47 bp, Homo Sapiens
  allele 24: 99-7976-324 : polymorphic base A or G
gtacaattccaggatgcacacccrgcaatctactgtgtttaatgcat

SEQ ID NO: 3627 - DNA, 47 bp, Homo Sapiens
  allele 24: 99-8000-88 : polymorphic base C or T
tgagtcaattaaacctctttcctytgtaaattatccagccttgagta

SEQ ID NO: 3628 - DNA, 47 bp, Homo Sapiens
  allele 24: 99-8006-241 : polymorphic base C or T
ctgtcttctgggaacaactcagayattaattttgaaagcagtgggtg

SEQ ID NO: 3629 - DNA, 47 bp, Homo Sapiens
  allele 24: 99-8038-47 : polymorphic base T or C
ggaagtctttgtttaacttccacytcattcttgagaaaagatttgag

SEQ ID NO: 3630 - DNA, 47 bp, Homo Sapiens
  allele 24: 99-8055-299 : polymorphic base A or G
cagggctttccaaaattaggccargggtccactgagtgcttggtggg

SEQ ID NO: 3631 - DNA, 47 bp, Homo Sapiens
  allele 24: 99-8059-59 : polymorphic base A or G
gcgacttctcagttcttttttccrcagtcctagattcctgtggagtt

SEQ ID NO: 3632 - DNA, 47 bp, Homo Sapiens
  allele 24: 99-8061-106 : polymorphic base C or T
ggaacttttcatctctgggtctcyggttcttcatttggttacatcaa

SEQ ID NO: 3633 - DNA, 47 bp, Homo Sapiens
  allele 24: 99-8109-168 : polymorphic base A or G
ctgcagtgagcattcaaatcctcraggaacagggtggggaggtggga

SEQ ID NO: 3634 - DNA, 47 bp, Homo Sapiens
  allele 24: 99-8115-238 : polymorphic base T or G
taaagccacggaaatttattctckcacaatcttggaaccagaagtgc

SEQ ID NO: 3635 - DNA, 47 bp, Homo Sapiens; identical to SEQ ID NO: 3610
  allele 24: 99-8166-370 : polymorphic base T or C

SEQ ID NO: 3636 - DNA, 47 bp, Homo Sapiens
  allele 24: 99-8226-78 : polymorphic base T or G
cccttccatggagcacgcttgagkactctgctccatggctcatggta

SEQ ID NO: 3637 - DNA, 47 bp, Homo Sapiens
  allele 24: 99-8232-303 : polymorphic base A or G
acaggccatctcaagaatatgacraagtagtgaaactatttcatcag

SEQ ID NO: 3638 - DNA, 47 bp, Homo Sapiens
  allele 24: 99-824-359 : polymorphic base C or T
aaggcagagaagtcccgcaaggtytcagtgctaaaaacttggaggca

SEQ ID NO: 3639 - DNA, 47 bp, Homo Sapiens
  allele 24: 99-8274-70 : polymorphic base A or G
cagtgtgggacacagactgacatrgaaagttcgaacacagaatttac

SEQ ID NO: 3640 - DNA, 47 bp, Homo Sapiens
  allele 24: 99-8359-153 : polymorphic base T or A
aaataaactagtaaaattagcacwtctaaaactgaacacaatttcta

SEQ ID NO: 3641 - DNA, 47 bp, Homo Sapiens
  allele 24: 99-8630-298 : polymorphic base G or A
agaaaagatctgaagaacctgagrtgccatccaaggaaatttggact

SEQ ID NO: 3642 - DNA, 47 bp, Homo Sapiens
  allele 24: 99-8659-399 : polymorphic base T or A
acatggtaaatttccaaggtaacwtctaaataaatggaaatagaata

SEQ ID NO: 3643 - DNA, 47 bp, Homo Sapiens
  allele 24: 99-8679-371 : polymorphic base T or G
acattcaacttttctaaacttttkttttctcatctgtaaaactgaag

SEQ ID NO: 3644 - DNA, 47 bp, Homo Sapiens
  allele 24: 99-8690-117 : polymorphic base T or C
ctggagttgtcctccaagagaatytttgtatggttccttttctgaga

SEQ ID NO: 3645 - DNA, 47 bp, Homo Sapiens
  allele 24: 99-8751-299 : polymorphic base C or T
agagtcccttagactccatcccaygcccagtgtctagcatagcacag

SEQ ID NO: 3646 - DNA, 47 bp, Homo Sapiens
  allele 24: 99-8795-58 : polymorphic base G or A
acttgtagctaatagaaggccctrccatcactttcaatctcaaaaca

SEQ ID NO: 3647 - DNA, 47 bp, Homo Sapiens
  allele 24: 99-882-250 : polymorphic base C or A
ctgcctgggatatgggtaacagamttatcactcatggaactttgtag

SEQ ID NO: 3648 - DNA, 47 bp, Homo Sapiens
  allele 24: 99-887-344 : polymorphic base G or T
atttggtaacttagtcacctttckttactttcagtcattacacctat

SEQ ID NO: 3649 - DNA, 47 bp, Homo Sapiens
  allele 24: 99-8875-283 : polymorphic base G or A
ttgctttattagtgaaatcgagcrcctttgctctggagggccttgat

SEQ ID NO: 3650 - DNA, 47 bp, Homo Sapiens
  allele 24: 99-892-77 : polymorphic base T or C
atgaaggctaacaaaggaggtacyttaacatactttttaacatacct

SEQ ID NO: 3651 - DNA, 47 bp, Homo Sapiens
  allele 24: 99-8936-202 : polymorphic base T or C
gacagaatcaccttcatgctgacytgctggaggtcagagaggctcag

SEQ ID NO: 3652 - DNA, 47 bp, Homo Sapiens
  allele 24: 99-8952-319 : polymorphic base G or C
gactcctggttgtggctagggtgstgtgatttgaaaccagcagttga

SEQ ID NO: 3653 - DNA, 47 bp, Homo Sapiens
  allele 24: 99-896-83 : polymorphic base T or C
gtttctcataatttgcgcagcttytgtaagatactttaagctatatt

SEQ ID NO: 3654 - DNA, 47 bp, Homo Sapiens
  allele 24: 99-899-252 : polymorphic base G or C
agcagatgcagttcctaccatcasagaactcatagtctagtccagga

SEQ ID NO: 3655 - DNA, 47 bp, Homo Sapiens
  allele 24: 99-9072-32 : polymorphic base G or C
gaggttctactacaaaatcagtgsaactcctaaacataaggaaacgg

SEQ ID NO: 3656 - DNA, 47 bp, Homo Sapiens
  allele 24: 99-9076-357 : polymorphic base C or T
cccacctgagactcagatcatcaycccttggtcctgtgtttccacgc

SEQ ID NO: 3657 - DNA, 47 bp, Homo Sapiens
  allele 24: 99-9077-52 : polymorphic base T or C
cagaagtactagttgtatataaayctggattctgagacacctataaa

SEQ ID NO: 3658 - DNA, 47 bp, Homo Sapiens
  allele 24: 99-9089-155 : polymorphic base T or A
tgttcttaggaaatacgatgactwgtatgtatttttaactgtattaa

SEQ ID NO: 3659 - DNA, 47 bp, Homo Sapiens
  allele 24: 99-9113-277 : polymorphic base C or A
ccccacattatacaaacagtttcmgaaagatgatagtaacatagcca

SEQ ID NO: 3660 - DNA, 47 bp, Homo Sapiens
  allele 24: 99-9145-438 : polymorphic base A or G
tcccatttctgggtgtagtccacrtgcaataattggttgatgtaggt

SEQ ID NO: 3661 - DNA, 47 bp, Homo Sapiens
  allele 24: 99-9164-365 : polymorphic base T or C
aagatcagattcacaagtttcctygctttctgcctcccggttgagtc

SEQ ID NO: 3662 - DNA, 47 bp, Homo Sapiens
  allele 24: 99-9308-416 : polymorphic base A or G
ggtccagctcacagctgtcactgrgtacagcggaaattgctcaccac

SEQ ID NO: 3663 - DNA, 47 bp, Homo Sapiens
  allele 24: 99-9316-399 : polymorphic base A or G
ccaattaatgagtttgatcgtacrtatatcaatcactgtgttctaca

SEQ ID NO: 3664 - DNA, 47 bp, Homo Sapiens
  allele 24: 99-9343-71 : polymorphic base C or T
catgtacacacacacattttgggycctccttataactaaaatcaaaa

SEQ ID NO: 3665 - DNA, 47 bp, Homo Sapiens
  allele 24: 99-9362-282 : polymorphic base T or C
aaactgtccttgtgtcctatagtyctttgaacataaagagccaaatt

SEQ ID NO: 3666 - DNA, 47 bp, Homo Sapiens
  allele 24: 99-9363-143 : polymorphic base G or A
cctaaaatagtgcaatataccgarttgatcaaaataaaatgaaggtt

SEQ ID NO: 3667 - DNA, 47 bp, Homo Sapiens
  allele 24: 99-9375-337 : polymorphic base G or C
ccagaaccttgctaactgtcctcsggcaagtgttcccagggctgagt

SEQ ID NO: 3668 - DNA, 47 bp, Homo Sapiens
  allele 24: 99-9380-292 : polymorphic base T or C
ggtgaaaccctgtctctacaaaayacagaattagctgggtgtggtgg

SEQ ID NO: 3669 - DNA, 47 bp, Homo Sapiens
  allele 24: 99-9607-402 : polymorphic base C or T
ctaacagtttgaaacctgtagtgyggaagcagggattggcattttta

SEQ ID NO: 3670 - DNA, 47 bp, Homo Sapiens
  allele 24: 99-9620-241 : polymorphic base C or T
ggactcttattaagtgaggctgaygatcgtattagagatggaccaat

SEQ ID NO: 3671 - DNA, 47 bp, Homo Sapiens
  allele 24: 99-9623-330 : polymorphic base T or C
atcgaatgctactatgacatttayagagatcacctcatttaatccct

SEQ ID NO: 3672 - DNA, 47 bp, Homo Sapiens
  allele 24: 99-9633-32 : polymorphic base T or C
ctggaaattcacttcagcccaaayagggaagccatcccaggacgcag

SEQ ID NO: 3673 - DNA, 47 bp, Homo Sapiens
  allele 24: 99-9636-423 : polymorphic base T or C
gatgggcagataaacaggtcgtcyccttgtggccttgcctgtacttc

SEQ ID NO: 3674 - DNA, 47 bp, Homo Sapiens
  allele 24: 99-9658-42 : polymorphic base T or G
tggtccccatctttgggattaaakaagcctttaaaatcaagggcttg

SEQ ID NO: 3675 - DNA, 47 bp, Homo Sapiens
  allele 24: 99-9662-213 : polymorphic base T or C
agggactgtttccccctgggtccyctccatgtccccagctgagatcc

SEQ ID NO: 3676 - DNA, 47 bp, Homo Sapiens
  allele 24: 99-9666-363 : polymorphic base T or C
agttgccaacatataggtgacatytaagtcctggggtagatatacca

SEQ ID NO: 3677 - DNA, 47 bp, Homo Sapiens
  allele 24: 99-9668-185 : polymorphic base C or T
gccccctgaacaagctctttgagygctggaagcatttcccatgcggc

SEQ ID NO: 3678 - DNA, 47 bp, Homo Sapiens
  allele 24: 99-9680-363 : polymorphic base A or G
aggaggcaaaacaataacagcacratctgaggccaatgcagacatgg

SEQ ID NO: 3679 - DNA, 47 bp, Homo Sapiens
  allele 24: 99-9696-292 : polymorphic base T or C
tgagaaaacccatcctcctttgayatttgtatcatttggctctatta

SEQ ID NO: 3680 - DNA, 47 bp, Homo Sapiens
  allele 24: 99-9697-375 : polymorphic base A or C
tatattcttaatctgaaactaaamtcctggaaataaaagaattgtaa

SEQ ID NO: 3681 - DNA, 47 bp, Homo Sapiens
  allele 24: 99-9700-289 : polymorphic base C or T
taacacactttataaaaaatgttyagattctacatagattcatgaaa

SEQ ID NO: 3682 - DNA, 47 bp, Homo Sapiens
  allele 24: 99-9704-445 : polymorphic base T or C
ttcaagagatctgttgtacaaaaycatgactatagtaaataacaacg

SEQ ID NO: 3683 - DNA, 47 bp, Homo Sapiens
  allele 24: 99-9706-448 : polymorphic base C or T
caatctattaaaccacgaatcccycactaaatgtgacctctatcttc

SEQ ID NO: 3684 - DNA, 47 bp, Homo Sapiens
  allele 24: 99-9709-115 : polymorphic base T or C
ggtaatgatatctaagaagaataytctaacagttgagaaaaagtgcc

SEQ ID NO: 3685 - DNA, 47 bp, Homo Sapiens
  allele 24: 99-9710-242 : polymorphic base C or A
ccctctgatctttgttagtaaggmttcgtgtcaggtgaaaaagtaag

SEQ ID NO: 3686 - DNA, 47 bp, Homo Sapiens
  allele 24: 99-9714-302 : polymorphic base T or C
caagtcatatagcaagttagtggycaatccagtaattctggaacctg

SEQ ID NO: 3687 - DNA, 47 bp, Homo Sapiens
  allele 24: 99-9717-449 : polymorphic base A or G
tcgcttcattttagttcacctacrttacttatgttttgttacatgtc

SEQ ID NO: 3688 - DNA, 47 bp, Homo Sapiens
  allele 24: 99-9726-190 : polymorphic base T or C
ttagggtaggtcctggtccaatayggctgatgtccttgtaagaagag

SEQ ID NO: 3689 - DNA, 47 bp, Homo Sapiens
  allele 24: 99-974-231 : polymorphic base A or G
aatatttcagagtgtatccaactrgtttcagccaatttccttaggga

SEQ ID NO: 3690 - DNA, 47 bp, Homo Sapiens
  allele 24: 99-9745-284 : polymorphic base G or A
gccgtagctcagatcctagctcargatgtcttgtctgggaagggcaa

SEQ ID NO: 3691 - DNA, 47 bp, Homo Sapiens
  allele 24: 99-9751-134 : polymorphic base A or T
ttatgaattgtatttcatgccaawtactaaagattacaaatatgaat

SEQ ID NO: 3692 - DNA, 47 bp, Homo Sapiens
  allele 24: 99-9765-237 : polymorphic base A or G
actccaacatacattggcttggargacaaagaggtctaactcctcac

SEQ ID NO: 3693 - DNA, 47 bp, Homo Sapiens
  allele 24: 99-9774-392 : polymorphic base A or T
ttagtacagtcaagacagaacacwtgtacatgcaggtcaagggtcat

SEQ ID NO: 3694 - DNA, 47 bp, Homo Sapiens
  allele 24: 99-9778-360 : polymorphic base A or G
tgtaaagtgctgaccaaatgagarbgctgtgacagcctggtaactgg

SEQ ID NO: 3695 - DNA, 47 bp, Homo Sapiens
  allele 24: 99-9781-174 : polymorphic base T or C
atggggatgtatattccacccatyttaatgcatgaaaagagtataaa

SEQ ID NO: 3696 - DNA, 47 bp, Homo Sapiens
  allele 24: 99-9785-141 : polymorphic base T or C
aaaaagcaatattgaatgagaacyagtcaaacaaagtaatttatatc

SEQ ID NO: 3697 - DNA, 47 bp, Homo Sapiens
  allele 24: 99-9810-257 : polymorphic base A or T
tttgaagtatattttcacatattwgcaatgaacaattggaaaacaaa

SEQ ID NO: 3698 - DNA, 47 bp, Homo Sapiens
  allele 24: 99-9811-369 : polymorphic base C or T
gagcagagaggagccttagcagcyatttagttcagccctttattttg

SEQ ID NO: 3699 - DNA, 47 bp, Homo Sapiens
  allele 24: 99-9820-483 : polymorphic base C or T
gcaaggttactaaaagaactgacytggggggctcatggctgctgggg

SEQ ID NO: 3700 - DNA, 47 bp, Homo Sapiens
  allele 24: 99-9822-257 : polymorphic base A or T
taaatctactttccacctacactwtgaaaaatccatttatagaaacc

SEQ ID NO: 3701 - DNA, 47 bp, Homo Sapiens
  allele 24: 99-9829-367 : polymorphic base G or A
aaaatacattgcaagattgcaacrggtagcacagcagagaagggctg

SEQ ID NO: 3702 - DNA, 47 bp, Homo Sapiens
  allele 24: 99-983-278 : polymorphic base G or A
tttatagtatttaagaccattgcrgagagaaataggtaatcaattta

SEQ ID NO: 3703 - DNA, 47 bp, Homo Sapiens
  allele 24: 99-9832-128 : polymorphic base T or C
agttattgctgctttgtccttcayacattaattatctgctggtgtaa

SEQ ID NO: 3704 - DNA, 47 bp, Homo Sapiens
  allele 24: 99-9833-167 : polymorphic base A or G
gatatagagaaaaattcattgaaracactaacaattttaagtatgtt

SEQ ID NO: 3705 - DNA, 47 bp, Homo Sapiens
  allele 24: 99-9835-217 : polymorphic base C or T
gaagtgccaccacagaatatttgyttctgagcactgaataagatagt

SEQ ID NO: 3706 - DNA, 47 bp, Homo Sapiens
  allele 24: 99-9837-275 : polymorphic base A or G
tggaacagccagcccatctaaaargctgcctactcatcagcctgctc

SEQ ID NO: 3707 - DNA, 47 bp, Homo Sapiens
  allele 24: 99-9839-416 : polymorphic base G or C
ctgtggctttattttctttgtccscatattctatcccaattacatag

SEQ ID NO: 3708 - DNA, 47 bp, Homo Sapiens
  allele 24: 99-9840-192 : polymorphic base C or T
tgccatttgtagccaatgccctcygggcccagacaaccactaatctg

SEQ ID NO: 3709 - DNA, 47 bp, Homo Sapiens
  allele 24: 99-9847-25 : polymorphic base A or G
aatagagaaagagagggctctcartcttcccaaaggcctatctctgt

SEQ ID NO: 3710 - DNA, 47 bp, Homo Sapiens
  allele 24: 99-9849-291 : polymorphic base G or A
gggatagaatagagaggacaaggrtaaaagctatactttttttaaga

SEQ ID NO: 3711 - DNA, 47 bp, Homo Sapiens
  allele 24: 99-9852-276 : polymorphic base T or C
tcctttctcagcctggtgtttgcyccttcctcctctggggcacacct

SEQ ID NO: 3712 - DNA, 47 bp, Homo Sapiens
  allele 24: 99-9854-316 : polymorphic base G or C
caataatctgatgtgtaccacttsaaatcagtgaggaaaagttaaaa

SEQ ID NO: 3713 - DNA, 47 bp, Homo Sapiens
  allele 24: 99-9856-252 : polymorphic base C or T
aataatgacaaggcaatgactatygaagtgcagcttcacctcacaat

SEQ ID NO: 3714 - DNA, 47 bp, Homo Sapiens
  allele 24: 99-9859-132 : polymorphic base C or A
gccgttgcatatcataaggcccamctccagccttcctggttccctgt

SEQ ID NO: 3715 - DNA, 47 bp, Homo Sapiens
  allele 24: 99-9866-365 : polymorphic base T or C
ggatcacaagtggatataacacayggccctcccaaaggaagctttaa

SEQ ID NO: 3716 - DNA, 47 bp, Homo Sapiens
  allele 24: 99-990-356 : polymorphic base T or A
agctgggggcagcctctggtccawctggcctggtgcccagccctgct

SEQ ID NO: 3717 - DNA, 47 bp, Homo Sapiens
  allele 24: 99-9906-280 : polymorphic base G or C
ctgttcatcctgttcatcttaggsgctcatcagaaccagagttacac

SEQ ID NO: 3718 - DNA, 47 bp, Homo Sapiens
  allele 24: 99-9908-423 : polymorphic base T or A
tttgtaagaatgccagataacacwtatgaataattttagaggcttca

SEQ ID NO: 3719 - DNA, 47 bp, Homo Sapiens
  allele 24: 99-991-157 : polymorphic base A or G
tacctgtagaggcaatcacttccrtctcctgcagaactgatgagcaa

SEQ ID NO: 3720 - DNA, 47 bp, Homo Sapiens
  allele 24: 99-9915-281 : polymorphic base T or G
gaaacaacccttggcaaccctagkacttaattgaatcaatgaagaag

SEQ ID NO: 3721 - DNA, 47 bp, Homo Sapiens
  allele 24: 99-9920-245 : polymorphic base T or C
tgacattcgaatacaagaaatacygagaacaccagctagatactatc

SEQ ID NO: 3722 - DNA, 47 bp, Homo Sapiens
  allele 24: 99-9921-365 : polymorphic base T or C
catcaaatttggtaagtttttggycataatgtcttcaaatatatttc

SEQ ID NO: 3723 - DNA, 47 bp, Homo Sapiens
  allele 24: 99-9922-154 : polymorphic base C or T
tttttcatgtgccttaaaaagttycaagtggttagcatgtattaaat

SEQ ID NO: 3724 - DNA, 47 bp, Homo Sapiens
  allele 24: 99-9926-454 : polymorphic base G or A
accctagaactaaagtataataaraaatgaaaataaaaaaagaaggc

SEQ ID NO: 3725 - DNA, 47 bp, Homo Sapiens
  allele 24: 99-9928-454 : polymorphic base C or T
attaaggtagaattgaaaagtagycatatttaagtacatagtttaaa

SEQ ID NO: 3726 - DNA, 47 bp, Homo Sapiens
  allele 24: 99-9929-144 : polymorphic base G or A
tgtcactctgtgaatagcttggcrtgtgggtgtttgctgtctttgcg

SEQ ID NO: 3727 - DNA, 47 bp, Homo Sapiens
  allele 24: 99-9935-418 : polymorphic base G or A
tatgtctaattcatccttatatcrccttacagatcctggcacatagc

SEQ ID NO: 3728 - DNA, 47 bp, Homo Sapiens
  allele 24: 99-9941-426 : polymorphic base T or A
aactaagattaaaatgaactatawccaagtatttttggtcctttgat

SEQ ID NO: 3729 - DNA, 47 bp, Homo Sapiens
  allele 24: 99-995-251 : polymorphic base A or C
ctggttaaatcaaatgaaattggmaatattcaaccactttaacctaa

SEQ ID NO: 3730 - DNA, 47 bp, Homo Sapiens
  allele 24: 99-996-210 : polymorphic base T or C
taagtacatttatcagggttgttygatgttttggcttctttggacca

SEQ ID NO: 3731 - DNA, 47 bp, Homo Sapiens
  allele 24: 99-9986-202 : polymorphic base T or C
gctttcttcatcataatgactatytcaggaactgagcacatgggtcc

SEQ ID NO: 3732 - DNA, 47 bp, Homo Sapiens
  allele 24: 99-9988-111 : polymorphic base T or G
agctagatttttcattttcctaakaaacagttataaatctgatgtat

SEQ ID NO: 3733 - DNA, 47 bp, Homo Sapiens
  allele 24: 99-9994-226 : polymorphic base C or A
agctgggtgagaaatgcaattgamgttggcagaggaacaggtgaggc

SEQ ID NO: 3734 - DNA, 47 bp, Homo Sapiens
  allele 24: 99-9995-50 : polymorphic base C or T
tacccagggactagaggactcacytgcctgctgggcccaccactacc

SEQ ID NO: 3735 - DNA, 47 bp, Homo Sapiens
  allele 24: 99-10069-366 : polymorphic base A or T
tatatcaatacttagtttcactawgaactgccaatttgtttccagaa

SEQ ID NO: 3736 - DNA, 47 bp, Homo Sapiens
  allele 24: 99-10074-266 : polymorphic base A or G
gttgccttataaattttcctgatrtcatgacctaattttacttcaga

SEQ ID NO: 3737 - DNA, 47 bp, Homo Sapiens
  allele 24: 99-10129-177 : polymorphic base A or G
taataaatcctttaagaccaacaraagccctatttttttttttttcc

SEQ ID NO: 3738 - DNA, 47 bp, Homo Sapiens
  allele 24: 99-10198-271 : polymorphic base A or G
agaaattgggaatactattgttargtttccccaagggaaattgacat

SEQ ID NO: 3739 - DNA, 47 bp, Homo Sapiens
  allele 24: 99-10306-345 : polymorphic base C or T
aattatagattattccattcttcyaaatgctcagccatattctgtat

SEQ ID NO: 3740 - DNA, 47 bp, Homo Sapiens
  allele 24: 99-10307-115 : polymorphic base A or G
acaaaacaggctgcaaagaaatcraaatattatggtttcactgatca

SEQ ID NO: 3741 - DNA, 47 bp, Homo Sapiens
  allele 24: 99-10326-149 : polymorphic base C or T
agtatttatacagagactgtaaaygaaataaacaagtttctaatctc

SEQ ID NO: 3742 - DNA, 47 bp, Homo Sapiens
  allele 24: 99-10393-179 : polymorphic base A or G
gttgttactttccaatgagaaagrggacggtgtgaaggggaacttca

SEQ ID NO: 3743 - DNA, 47 bp, Homo Sapiens
  allele 24: 99-10685-454 : polymorphic base A or C
actggtttctatggagttaccctmctgaattgaatattgaatagtta

SEQ ID NO: 3744 - DNA, 47 bp, Homo Sapiens
  allele 24: 99-10857-217 : polymorphic base C or T
ttacaaatgagtcctaaattccayataaagtgtgttcagggttttat

SEQ ID NO: 3745 - DNA, 47 bp, Homo Sapiens
  allele 24: 99-10948-281 : polymorphic base C or T
cctattttgattggaacgtttcaycgcttttctctatcactgtagca

SEQ ID NO: 3746 - DNA, 47 bp, Homo Sapiens
  allele 24: 99-11104-329 : polymorphic base A or G
atgtctggccaagaatgaagcctrtgaaaaggtaagtgaaagtgctt

SEQ ID NO: 3747 - DNA, 47 bp, Homo Sapiens
  allele 24: 99-11116-199 : polymorphic base C or T
aaaatgtttttattctgcccttayatttgacggaaagtttgactata

SEQ ID NO: 3748 - DNA, 47 bp, Homo Sapiens
  allele 24: 99-11117-282 : polymorphic base A or G
aacaatatttaagctggccatgcrtcaataacataatactgctctta

SEQ ID NO: 3749 - DNA, 47 bp, Homo Sapiens
  allele 24: 99-11121-461 : polymorphic base A or G
agggcattgaagaagtccttctgrtcgttgaccatctgtccacagac

SEQ ID NO: 3750 - DNA, 47 bp, Homo Sapiens
  allele 24: 99-11124-363 : polymorphic base C or T
tttttgccatctttaataaataayttgttaatgaatcattttaggaa

SEQ ID NO: 3751 - DNA, 47 bp, Homo Sapiens
  allele 24: 99-11172-373 : polymorphic base C or T
tctaggcctttccaccccaacccygataaaaacattttgcatatata

SEQ ID NO: 3752 - DNA, 47 bp, Homo Sapiens
  allele 24: 99-11206-379 : polymorphic base C or T
tgtccacagactttcgtgggccaygtcagcttcttcaaagaggccga

SEQ ID NO: 3753 - DNA, 47 bp, Homo Sapiens
  allele 24: 99-11303-223 : polymorphic base C or T
tctcaggcagatttgggtggtaayatgacctcatttgactcccaggc

SEQ ID NO: 3754 - DNA, 47 bp, Homo Sapiens
  allele 24: 99-11307-168 : polymorphic base G or T
ctaagcttcctcttcaaaaaccckgggtgttgagccagatgcctttt

SEQ ID NO: 3755 - DNA, 47 bp, Homo Sapiens
  allele 24: 99-11325-188 : polymorphic base A or G
aggattcagtgaaactgttcaccrcctggagcccatgtggactccag

SEQ ID NO: 3756 - DNA, 47 bp, Homo Sapiens
  allele 24: 99-11365-273 : polymorphic base C or T
ccaggcttgcaggagtcctccaayggggctctgaaagttaatttatc

SEQ ID NO: 3757 - DNA, 47 bp, Homo Sapiens
  allele 24: 99-11389-268 : polymorphic base A or T
tttcgagtaatttcaggaaaaaawtkttttttcgttgagagttttta

SEQ ID NO: 3758 - DNA, 47 bp, Homo Sapiens
  allele 24: 99-11395-376 : polymorphic base A or G
cttcagagagacagacaagtgaarctggctcagaggtcatgtggacc

SEQ ID NO: 3759 - DNA, 47 bp, Homo Sapiens
  allele 24: 99-11500-50 : polymorphic base C or T
gcccatttaagctcctgtatagaygctccttkttattaggccccagt

SEQ ID NO: 3760 - DNA, 47 bp, Homo Sapiens
  allele 24: 99-11571-88 : polymorphic base G or T
actcatcactctggcatcagagckttctccggcgcctcccaccccta

SEQ ID NO: 3761 - DNA, 47 bp, Homo Sapiens
  allele 24: 99-11710-452 : polymorphic base A or G
ccaagtaaccagcttgaggacatragtggcagaggggtccctttata

SEQ ID NO: 3762 - DNA, 47 bp, Homo Sapiens
  allele 24: 99-1173-208 : polymorphic base A or T
ttgaattgcattaaaaaaggtgawgttttagaagttgagaaatgtga

SEQ ID NO: 3763 - DNA, 47 bp, Homo Sapiens
  allele 24: 99-11735-215 : polymorphic base C or T
gaagtatttatgcttagctctttyatccacctggagcttatttttgc

SEQ ID NO: 3764 - DNA, 47 bp, Homo Sapiens
  allele 24: 99-11864-218 : polymorphic base A or C
tgtggttggagatcacagcaggtmccccacagggtgggcggtttctt

SEQ ID NO: 3765 - DNA, 47 bp, Homo Sapiens
  allele 24: 99-1187-293 : polymorphic base G or C
ccacagttattttgtggtgtttgsctgtagtcaactggttatggtgt

SEQ ID NO: 3766 - DNA, 47 bp, Homo Sapiens
  allele 24: 99-11872-228 : polymorphic base C or T
gcccccaacatttccactggtggyagggtagtgatagtcgcaggagg

SEQ ID NO: 3767 - DNA, 47 bp, Homo Sapiens
  allele 24: 99-11878-212 : polymorphic base C or T
gaggcaggagaatcacttgaactygggaggcagaggttgcagtgagc

SEQ ID NO: 3768 - DNA, 47 bp, Homo Sapiens
  allele 24: 99-11905-202 : polymorphic base G or C
tacgaagtcttcaagagaaagcascgaggctaggaaaggtttctcct

SEQ ID NO: 3769 - DNA, 47 bp, Homo Sapiens
  allele 24: 99-11932-48 : polymorphic base C or T
gcttgtttactctctgtccacccyagccctctcatcatggtgcacct

SEQ ID NO: 3770 - DNA, 47 bp, Homo Sapiens
  allele 24: 99-11964-158 : polymorphic base A or C
tatttaacgcagttggttaaactmtaggatggcctttacagttccaa

SEQ ID NO: 3771 - DNA, 47 bp, Homo Sapiens
  allele 24: 99-12164-412 : polymorphic base C or T
catagacttttatacttcttgagytaactttttgactaaggcataca

SEQ ID NO: 3772 - DNA, 47 bp, Homo Sapiens
  allele 24: 99-12227-278 : polymorphic base G or C
gatgttatgaaggtgcttatatasagggtgctttattagagaattat

SEQ ID NO: 3773 - DNA, 47 bp, Homo Sapiens
  allele 24: 99-12417-447 : polymorphic base A or G
gaaggcccactgccccaggggacraaggtcctctgagtcagaagcca

SEQ ID NO: 3774 - DNA, 47 bp, Homo Sapiens
  allele 24: 99-12459-119 : polymorphic base G or T
ctgggatcactggtgtcacggagkgggaggccttggtctgagggggc

SEQ ID NO: 3775 - DNA, 47 bp, Homo Sapiens
  allele 24: 99-12521-212 : polymorphic base C or T
tcatggcgactggcaggcaacacycaggatttcaggaactggggaga

SEQ ID NO: 3776 - DNA, 47 bp, Homo Sapiens
  allele 24: 99-12569-95 : polymorphic base A or G
cagcagtatgtgaaactcacaccrccaatgaggcagttcccaacacg

SEQ ID NO: 3777 - DNA, 47 bp, Homo Sapiens
  allele 24: 99-1298-430 : polymorphic base A or G
cagtttcatgatcccaaaagtatrccctccatgaatatgtagtctta

SEQ ID NO: 3778 - DNA, 47 bp, Homo Sapiens
  allele 24: 99-1315-105 : polymorphic base G or C
gaaaaagaagaagtgggcagtcasatagaaaacctatttaataaaat

SEQ ID NO: 3779 - DNA, 47 bp, Homo Sapiens
  allele 24: 99-13154-74 : polymorphic base C or T
cttcagaatgttcactctctgaaytgacgtttgattacaaaatttta

SEQ ID NO: 3780 - DNA, 47 bp, Homo Sapiens
  allele 24: 99-13155-134 : polymorphic base A or G
atggaagacacgtgtagtcatccrtcatcacagctctgcaaactttt

SEQ ID NO: 3781 - DNA, 47 bp, Homo Sapiens
  allele 24: 99-13249-461 : polymorphic base C or T
tatatttctctgtgtttactcttyggcaggagctgtcactgttcatc

SEQ ID NO: 3782 - DNA, 47 bp, Homo Sapiens
  allele 24: 99-13794-147 : polymorphic base G or C
ggcaccatgacacaccaaccattsgcctgggccagcttgcacgcctg

SEQ ID NO: 3783 - DNA, 47 bp, Homo Sapiens
  allele 24: 99-14899-215 : polymorphic base A or C
actctgccatgggtgccaggaccmaatttttccctggctaactcggt

SEQ ID NO: 3784 - DNA, 47 bp, Homo Sapiens
  allele 24: 99-16351-44 : polymorphic base C or T
aagttgacatatatcctagggttyccttgtcagagggcagcagggtc

SEQ ID NO: 3785 - DNA, 47 bp, Homo Sapiens
  allele 24: 99-16436-382 : polymorphic base A or G
agttctgttttatgaaatggagtrttgcctgattccagaatcacaga

SEQ ID NO: 3786 - DNA, 47 bp, Homo Sapiens
  allele 24: 99-16753-387 : polymorphic base G or C
tctgaccttaaaacatttacactstcttggagaggaagtgtaatgtt

SEQ ID NO: 3787 - DNA, 47 bp, Homo Sapiens
  allele 24: 99-1807-300 : polymorphic base A or G
aatagctcaattggtctttttctrtagtgtctagataaaaataaatc

SEQ ID NO: 3788 - DNA, 47 bp, Homo Sapiens
  allele 24: 99-19032-132 : polymorphic base A or C
cagacgcccttgtgtgctggctcmgtgtccactaggctgtgggttcc

SEQ ID NO: 3789 - DNA, 47 bp, Homo Sapiens
  allele 24: 99-19212-369 : polymorphic base C or T
tccacagccaccgtctaacactgyygtgggctgttctcatcccaacc

SEQ ID NO: 3790 - DNA, 47 bp, Homo Sapiens
  allele 24: 99-19273-219 : polymorphic base A or G
cctgggacaaggttccattttgcratgagagggtgtgggtggcacag

SEQ ID NO: 3791 - DNA, 47 bp, Homo Sapiens
  allele 24: 99-19279-356 : polymorphic base C or T
tggcagagggatcttgctggggayaggcagagactaattttcagatg

SEQ ID NO: 3792 - DNA, 47 bp, Homo Sapiens
  allele 24: 99-19541-172 : polymorphic base A or G
atgataagtaatattaattagggragaagatattcagtcaaactttc

SEQ ID NO: 3793 - DNA, 47 bp, Homo Sapiens
  allele 24: 99-19552-214 : polymorphic base G or T
gactgagatggcatctacacgtakaatagcagagaatgaaggattaa

SEQ ID NO: 3794 - DNA, 47 bp, Homo Sapiens
  allele 24: 99-21051-435 : polymorphic base C or T
acggctgcaaattccttgcttttyagatacacattgcatatctggct

SEQ ID NO: 3795 - DNA, 43 bp, Homo Sapiens
  allele 20: 99-21246-20 : polymorphic base C or T
ggtttggtactgattactgyctagggtttccctggcactgaaa

SEQ ID NO: 3796 - DNA, 47 bp, Homo Sapiens
  allele 24: 99-21387-465 : polymorphic base C or T
ccagctgcagggaagctgatggayatcctgtcctccctgcctgtccc

SEQ ID NO: 3797 - DNA, 47 bp, Homo Sapiens
  allele 24: 99-21407-352 : polymorphic base A or G
ggctggaatgaggaactaagctgratttcttggggccccaagttaga

SEQ ID NO: 3798 - DNA, 47 bp, Homo Sapiens
  allele 24: 99-21418-83 : polymorphic base C or T
atctagtcccacattcgcagcatygaggcaagtactgatgaagaaag

SEQ ID NO: 3799 - DNA, 47 bp, Homo Sapiens
  allele 24: 99-21419-85 : polymorphic base C or T
agctcatgggtgttcagagaccaygacgctggaaccctcacagagac

SEQ ID NO: 3800 - DNA, 47 bp, Homo Sapiens
  allele 24: 99-21430-308 : polymorphic base C or T
gacagtatatcaggaatacactayccagggtggaaaatcagagagag

SEQ ID NO: 3801 - DNA, 47 bp, Homo Sapiens
  allele 24: 99-21435-96 : polymorphic base A or G
ccaggatagagtgggccagggtgratatatgttgggtgaatgagctt

SEQ ID NO: 3802 - DNA, 47 bp, Homo Sapiens
  allele 24: 99-21446-240 : polymorphic base C or T
tcccagaaactgccacacaatttygtaaaatttgctttttagggccc

SEQ ID NO: 3803 - DNA, 47 bp, Homo Sapiens
  allele 24: 99-21452-173 : polymorphic base A or G
aagtacacattcagggccccatcraatcacagggaggccgtgatgga

SEQ ID NO: 3804 - DNA, 47 bp, Homo Sapiens
  allele 24: 99-21488-376 : polymorphic base G or T
cccttttcctttctaccctagaakaaacatctgggttctccagtcag

SEQ ID NO: 3805 - DNA, 47 bp, Homo Sapiens
  allele 24: 99-21489-227 : polymorphic base C or T
aacaaaaaaacacaaagaagtgaygtgtccttcccttctcagtgcat

SEQ ID NO: 3806 - DNA, 47 bp, Homo Sapiens
  allele 24: 99-21496-248 : polymorphic base C or T
atgaaagagggaacacgaaccctygtatgacagagacctacacttcg

SEQ ID NO: 3807 - DNA, 47 bp, Homo Sapiens
  allele 24: 99-21519-446 : polymorphic base A or G
gtgccagcacagccaccccagggratgccccatggctgttcaggaag

SEQ ID NO: 3808 - DNA, 47 bp, Homo Sapiens
  allele 24: 99-21618-178 : polymorphic base A or G
cactctcctggtgccccacagacrtctgcacctgcagggttgtcttg

SEQ ID NO: 3809 - DNA, 47 bp, Homo Sapiens
  allele 24: 99-21725-371 : polymorphic base C or T
tggagttcgggctgtgggaaccaygccggtgaaatacccacctgagg

SEQ ID NO: 3810 - DNA, 47 bp, Homo Sapiens
  allele 24: 99-21773-155 : polymorphic base A or C
ccacagggagcaccaactagggcmcccaataccacctgctgacctgc

SEQ ID NO: 3811 - DNA, 47 bp, Homo Sapiens
  allele 24: 99-21781-252 : polymorphic base A or G
ggcaggagaatcatgtgaaccctrgaggctgagtttacagtgagcca

SEQ ID NO: 3812 - DNA, 47 bp, Homo Sapiens
  allele 24: 99-21820-230 : polymorphic base A or G
gcaggtatgaaagtggcttatgtrtataaataggttgctgttatttt

SEQ ID NO: 3813 - DNA, 47 bp, Homo Sapiens
  allele 24: 99-21822-50 : polymorphic base A or G
ttataaacaggaaaccaaggtccrgagactgaatgactctgggctca

SEQ ID NO: 3814 - DNA, 47 bp, Homo Sapiens
  allele 24: 99-21939-170 : polymorphic base A or T
aatgcccccaggacacagctgacwgctcagcaccctgaagcacctga

SEQ ID NO: 3815 - DNA, 47 bp, Homo Sapiens
  allele 24: 99-22404-59 : polymorphic base A or G
ttctttttctttttaaaatgacaratttaacttcagcatcctttttc

SEQ ID NO: 3816 - DNA, 47 bp, Homo Sapiens
  allele 24: 99-22594-395 : polymorphic base A or G
aggaggcaccccaccacaccggcrtgttccacgggccatgatcagcc

SEQ ID NO: 3817 - DNA, 47 bp, Homo Sapiens
  allele 24: 99-22679-148 : polymorphic base A or C
cagcctggcatccctgcacagcamtggggccaaggtcaccctccctc

SEQ ID NO: 3818 - DNA, 47 bp, Homo Sapiens
  allele 24: 99-23095-184 : polymorphic base G or C
agaccctagagagagggacccctsaggtctacaggagcccagctcca

SEQ ID NO: 3819 - DNA, 47 bp, Homo Sapiens
  allele 24: 99-23370-249 : polymorphic base C or T
gtagtgggaccccctactagggtyaggaagtggacactaacatctgt

SEQ ID NO: 3820 - DNA, 47 bp, Homo Sapiens
  allele 24: 99-23568-395 : polymorphic base G or C
aaaactatgactgttcatattctstttcctaaaggacatgtgaatac

SEQ ID NO: 3821 - DNA, 47 bp, Homo Sapiens
  allele 24: 99-23824-339 : polymorphic base C or T
caccactatcccacagatacctcytgggtattgctcttctgcctttt

SEQ ID NO: 3822 - DNA, 47 bp, Homo Sapiens
  allele 24: 99-23969-316 : polymorphic base C or T
cagctgaattgagacccaatcccytgattaggcattgcttttagtat

SEQ ID NO: 3823 - DNA, 47 bp, Homo Sapiens
  allele 24: 99-24032-138 : polymorphic base A or T
cctggccagccctcagagctcacwaggtcatccagcacaaggaaagt

SEQ ID NO: 3824 - DNA, 47 bp, Homo Sapiens
  allele 24: 99-24048-286 : polymorphic base C or T
agactgcttcatcgccgtgtcagygtggtatgtacagtaagcgtact

SEQ ID NO: 3825 - DNA, 47 bp, Homo Sapiens
  allele 24: 99-24074-190 : polymorphic base A or G
agaggaggcaagcgagaggctccrcgccaagccgagaacctacttaa

SEQ ID NO: 3826 - DNA, 47 bp, Homo Sapiens
  allele 24: 99-24082-408 : polymorphic base A or C
cctctgagctctttctctcggcgmctggaccagagcctggagtgcac

SEQ ID NO: 3827 - DNA, 47 bp, Homo Sapiens
  allele 24: 99-24104-308 : polymorphic base G or T
tgtatagactttatgtcttccaaktttaaaaaaagagacagggtctt

SEQ ID NO: 3828 - DNA, 47 bp, Homo Sapiens
  allele 24: 99-24138-224 : polymorphic base A or G
ggtaggcgaggggcatttagggtractgagctgctgccggggcctgg

SEQ ID NO: 3829 - DNA, 47 bp, Homo Sapiens
  allele 24: 99-24172-116 : polymorphic base C or T
tgcaaataaggtgaactctatgaygacttggcactttgtcaactgta

SEQ ID NO: 3830 - DNA, 47 bp, Homo Sapiens
  allele 24: 99-24267-190 : polymorphic base A or C
gaaaaaagtaggttttaattgaamctcttttcatttcatccatttta

SEQ ID NO: 3831 - DNA, 47 bp, Homo Sapiens
  allele 24: 99-24949-289 : polymorphic base C or T
cctccgtctccccgctcattgctytggccaacaatggagatacccag

SEQ ID NO: 3832 - DNA, 47 bp, Homo Sapiens
  allele 24: 99-253-97 : polymorphic base A or G
ggaagaagaacctcctttttatcrtcatccctttaaactcagtgaac

SEQ ID NO: 3833 - DNA, 47 bp, Homo Sapiens
  allele 24: 99-2694-411 : polymorphic base A or G
cagattctgatctgttgtcttcaragtgcagcttcaaatcccttcta

SEQ ID NO: 3834 - DNA, 47 bp, Homo Sapiens
  allele 24: 99-2697-336 : polymorphic base A or G
gcccatcagtgcttgcgcttactrcagcaggcttccttgagcagcac

SEQ ID NO: 3835 - DNA, 47 bp, Homo Sapiens
  allele 24: 99-2720-280 : polymorphic base A or G
cctggaaaatgcccatacacccarctacacatacaattccagaattt

SEQ ID NO: 3836 - DNA, 47 bp, Homo Sapiens
  allele 24: 99-2851-105 : polymorphic base G or C
ggctgaatctattatcaccatttstcatgtgggaaacagaagttcag

SEQ ID NO: 3837 - DNA, 47 bp, Homo Sapiens
  allele 24: 99-2889-197 : polymorphic base C or T
tgacacagcgtgacaaatgacaayagtcgcaacaagggcaaacagaa

SEQ ID NO: 3838 - DNA, 47 bp, Homo Sapiens
  allele 24: 99-3072-323 : polymorphic base A or G
ctgagttacctgggtagtcatacrtcttcctaggagccttctaagag

SEQ ID NO: 3839 - DNA, 47 bp, Homo Sapiens
  allele 24: 99-3089-49 : polymorphic base A or G
ttactaaaagaaaacataggacartattggacccattaattaaaaac

SEQ ID NO: 3840 - DNA, 47 bp, Homo Sapiens
  allele 24: 99-3157-203 : polymorphic base G or T
cccaaggcccaggcagctcctggktgctggcttggaggatgagtggt

SEQ ID NO: 3841 - DNA, 47 bp, Homo Sapiens
  allele 24: 99-3210-341 : polymorphic base G or T
tatgtgaggaaagcagaaaccackctaggtatttcaaacaagtgtat

SEQ ID NO: 3842 - DNA, 47 bp, Homo Sapiens
  allele 24: 99-3218-344 : polymorphic base A or G
tgtccattagtagaagagcaagaragccttggatgtcaacgcctcgc

SEQ ID NO: 3843 - DNA, 47 bp, Homo Sapiens
  allele 24: 99-3251-254 : polymorphic base G or T
gaatgtgaaataggcaaaccactktgggatgaataccctcctctccc

SEQ ID NO: 3844 - DNA, 47 bp, Homo Sapiens
  allele 24: 99-3298-158 : polymorphic base C or T
  misc_feature 15..20: n=a, g, c or t
agcctcccaaagtgnnnnnnttayaggtatgagccaccagctccagc

SEQ ID NO: 3845 - DNA, 47 bp, Homo Sapiens
  allele 24: 99-3300-433 : polymorphic base A or G
atatgaaaactttagtggtcatcrtggaaaatactgttgagccaagt

SEQ ID NO: 3846 - DNA, 47 bp, Homo Sapiens
  allele 24: 99-3364-247 : polymorphic base A or T
aattctgtctctgagctccctggwgaccttagggagaggaatgatct

SEQ ID NO: 3847 - DNA, 47 bp, Homo Sapiens
  allele 24: 99-3427-271 : polymorphic base A or G
accccgcccgctggctgtgccccraggccatctccttcttggggaac

SEQ ID NO: 3848 - DNA, 47 bp, Homo Sapiens
  allele 24: 99-3484-96 : polymorphic base A or G
aaagtttaactattaaagaaagarttcctgggatgccacctaaaacc

SEQ ID NO: 3849 - DNA, 47 bp, Homo Sapiens
  allele 24: 99-3537-196 : polymorphic base A or G
agtctcaggtagttctttataacratgtgagaatgaattaatataat

SEQ ID NO: 3850 - DNA, 47 bp, Homo Sapiens
  allele 24: 99-3568-156 : polymorphic base G or T
cagagacttcccagaagccccttktgtggttctagctttgttcccca

SEQ ID NO: 3851 - DNA, 47 bp, Homo Sapiens
  allele 24: 99-3592-325 : polymorphic base A or G
aggtctgatccgagggtggtctcrtctttgtcttagcagccgaggtc

SEQ ID NO: 3852 - DNA, 47 bp, Homo Sapiens
  allele 24: 99-3602-245 : polymorphic base C or T
gcacgggccatgggggaacagacygtggagggccacagtctctggga

SEQ ID NO: 3853 - DNA, 47 bp, Homo Sapiens
  allele 24: 99-3608-264 : polymorphic base A or G
ctgtgcaggcagcctgggagcttrttccccaggagtgtaagaaaggc

SEQ ID NO: 3854 - DNA, 47 bp, Homo Sapiens
  allele 24: 99-3643-352 : polymorphic base A or G
aggcagctccgacatcgccccaarccccctccaatcccagggcgcca

SEQ ID NO: 3855 - DNA, 47 bp, Homo Sapiens
  allele 24: 99-3770-363 : polymorphic base C or T
atgtggacattgttcacatctcayagggctgaaagtcaatgagcaag

SEQ ID NO: 3856 - DNA, 47 bp, Homo Sapiens
  allele 24: 99-3772-266 : polymorphic base A or G
acatatgaggcagctgagagtaartgaggaccatgtggtaaaatgat

SEQ ID NO: 3857 - DNA, 47 bp, Homo Sapiens
  allele 24: 99-3790-361 : polymorphic base A or G
cagagggcctagatagacctgccrtcctcagaaggcgactagtggca

SEQ ID NO: 3858 - DNA, 47 bp, Homo Sapiens
  allele 24: 99-3818-255 : polymorphic base A or G
tatctttggcccaaaggtcacatrgcagactacaatccaagctggga

SEQ ID NO: 3859 - DNA, 47 bp, Homo Sapiens
  allele 24: 99-3863-328 : polymorphic base A or G
tagataggatgcccgtctggcccraagtggaatttcttaccatctgt

SEQ ID NO: 3860 - DNA, 47 bp, Homo Sapiens
  allele 24: 99-3879-245 : polymorphic base A or G
ttcctaacctggttttactccccrttgctgacttcacagcttgttaa

SEQ ID NO: 3861 - DNA, 47 bp, Homo Sapiens
  allele 24: 99-3882-312 : polymorphic base C or T
tcactgcccatcagaacagcctcygacaaagctgcatccaaattctt

SEQ ID NO: 3862 - DNA, 47 bp, Homo Sapiens
  allele 24: 99-3883-329 : polymorphic base C or T
tgtatggctcacttactccttttygtgtctatcttctaagcatttta

SEQ ID NO: 3863 - DNA, 47 bp, Homo Sapiens
  allele 24: 99-3884-355 : polymorphic base G or C
gcagagacctgggcaaggagagtscggtcagggaaagctctcctggg

SEQ ID NO: 3864 - DNA, 47 bp, Homo Sapiens
  allele 24: 99-3894-333 : polymorphic base C or T
gcatagagaccaagggctgcttcyggaaggaggagggaaacttggtg

SEQ ID NO: 3865 - DNA, 47 bp, Homo Sapiens
  allele 24: 99-3936-352 : polymorphic base A or G
caaatacatgaatattttaccacraaattgccatataatatcttgtc

SEQ ID NO: 3866 - DNA, 47 bp, Homo Sapiens
  allele 24: 99-3946-236 : polymorphic base A or G
tgtgtttgaactattgctttaggrtttaaaataggggagcctgtggt

SEQ ID NO: 3867 - DNA, 47 bp, Homo Sapiens
  allele 24: 99-4029-174 : polymorphic base C or T
cattgacgtgccatggaacgtggycccggagaaagcccatttgctga

SEQ ID NO: 3868 - DNA, 47 bp, Homo Sapiens
  allele 24: 99-4036-308 : polymorphic base C or T
gctggcatgggggggtcctctccygctccgctcctaccgtcgtcctc

SEQ ID NO: 3869 - DNA, 47 bp, Homo Sapiens
  allele 24: 99-4102-109 : polymorphic base A or G
ccggcgacagcaggcagtggtccrgcggccactcaggacttcagcaa

SEQ ID NO: 3870 - DNA, 47 bp, Homo Sapiens
  allele 24: 99-4110-180 : polymorphic base A or G
ttcaaaagaatggctcgcagatcrttgagaaaaatatccctgcgttg

SEQ ID NO: 3871 - DNA, 47 bp, Homo Sapiens
  allele 24: 99-4111-259 : polymorphic base A or G
acccacggcccaaagctctgcccrtggggacactttctccctggttg

SEQ ID NO: 3872 - DNA, 47 bp, Homo Sapiens
  allele 24: 99-4126-366 : polymorphic base A or G
catctcacaatccttacatcatarattccaggatcaggaagggggca

SEQ ID NO: 3873 - DNA, 47 bp, Homo Sapiens
  allele 24: 99-4157-72 : polymorphic base A or G
ttgacagcacctcagaggcaggcrtgggcatgggcgtgagtgttgca

SEQ ID NO: 3874 - DNA, 47 bp, Homo Sapiens
  allele 24: 99-4228-168 : polymorphic base C or T
tacttaaacctcccaaaacaatayggcccttaggaggggccacacct

SEQ ID NO: 3875 - DNA, 47 bp, Homo Sapiens
  allele 24: 99-4239-328 : polymorphic base A or G
gagaactgaaggtaaaataaaatrtcagcttatggcttggcaaacac

SEQ ID NO: 3876 - DNA, 47 bp, Homo Sapiens
  allele 24: 99-4254-307 : polymorphic base A or G
aacagccttgggctcacgttacarcagcatccccaaggagcctcctg

SEQ ID NO: 3877 - DNA, 47 bp, Homo Sapiens
  allele 24: 99-4264-228 : polymorphic base C or T
acagggagaaccagagtgatgacyccaacctcccaatggggttcgga

SEQ ID NO: 3878 - DNA, 47 bp, Homo Sapiens
  allele 24: 99-4311-146 : polymorphic base A or G
ctaagatctcacgattagttaacrgcaaagcaggtttctgttctttt

SEQ ID NO: 3879 - DNA, 47 bp, Homo Sapiens
  allele 24: 99-4381-385 : polymorphic base C or T
ttagtgaaatttgattgcagatayacaatgactactttttctggtgt

SEQ ID NO: 3880 - DNA, 47 bp, Homo Sapiens
  allele 24: 99-4403-194 : polymorphic base A or C
ttttacaatttcctgttggatggmagaatttgaagacagtttgttct

SEQ ID NO: 3881 - DNA, 47 bp, Homo Sapiens
  allele 24: 99-4524-296 : polymorphic base A or G
gatgcagatgcagacagcaggtcrttagatgaaatagattgctgtgt

SEQ ID NO: 3882 - DNA, 47 bp, Homo Sapiens
  allele 24: 99-4582-359 : polymorphic base G or T
acagggtttcaccgtgttagccakgatggtctcgatctcctgacctc

SEQ ID NO: 3883 - DNA, 47 bp, Homo Sapiens
  allele 24: 99-4611-151 : polymorphic base C or T
cgggaaggagtctacacagtcttygctcccacaaatgaagccttccg

SEQ ID NO: 3884 - DNA, 47 bp, Homo Sapiens
  allele 24: 99-4689-375 : polymorphic base A or T
attccctgtatcgtagttctgatwtaattgctatttagaataaaact

SEQ ID NO: 3885 - DNA, 47 bp, Homo Sapiens
  allele 24: 99-4762-114 : polymorphic base A or G
tgacctaagcaacatcaagccatragggttgcattccctcttcagtt

SEQ ID NO: 3886 - DNA, 47 bp, Homo Sapiens
  allele 24: 99-4878-107 : polymorphic base C or T
ataaaccaatccactggcatcttyacccagtctgttttctcacatga

SEQ ID NO: 3887 - DNA, 47 bp, Homo Sapiens
  allele 24: 99-5075-219 : polymorphic base C or T
tctagaaatcctaaattttaaaaygctaaaaagtcagcgatagtttc

SEQ ID NO: 3888 - DNA, 47 bp, Homo Sapiens
  allele 24: 99-5190-277 : polymorphic base A or G
cctagaccctgtaggacatctatrtacctatcaggatcatctgaaaa

SEQ ID NO: 3889 - DNA, 47 bp, Homo Sapiens
  allele 24: 99-5605-90 : polymorphic base G or T
gatgcaggctgcagattcctcagkgggtacttggagacagagggacc

SEQ ID NO: 3890 - DNA, 47 bp, Homo Sapiens
  allele 24: 99-5882-105 : polymorphic base C or T
ttagatgaggtttatttttatttytgatattattcattcttgtcaca

SEQ ID NO: 3891 - DNA, 47 bp, Homo Sapiens
  allele 24: 99-5977-241 : polymorphic base C or T
gaccctgagaggctttttcctggycccttagttgtgagttttcctgc

SEQ ID NO: 3892 - DNA, 47 bp, Homo Sapiens
  allele 24: 99-5993-323 : polymorphic base C or T
ccagcctctgagcttgtttatgaygaatgacaatgaataacttccaa

SEQ ID NO: 3893 - DNA, 47 bp, Homo Sapiens
  allele 24: 99-5994-205 : polymorphic base G or T
ccaaacaagggggctgctggaatkcaagtgtgctgcccaaggagact

SEQ ID NO: 3894 - DNA, 47 bp, Homo Sapiens
  allele 24: 99-6827-399 : polymorphic base A or G
caggggtcgaattttaactaccgrgcttaggtcaggcaggcccaggc

SEQ ID NO: 3895 - DNA, 47 bp, Homo Sapiens
  allele 24: 99-7076-198 : polymorphic base C or T
tccctaacacttccttgggaatcygcaccacctcactctcagtcctc

SEQ ID NO: 3896 - DNA, 47 bp, Homo Sapiens
  allele 24: 99-7215-279 : polymorphic base C or T
tctggggtgtccgagcccctgagycgagtaaagttgggcacattacg

SEQ ID NO: 3897 - DNA, 47 bp, Homo Sapiens
  allele 24: 99-8206-133 : polymorphic base A or G
caaagggtgaggttggagtgaaartttaataagcgaaagaagaaagc

SEQ ID NO: 3898 - DNA, 47 bp, Homo Sapiens
  allele 24: 99-8614-236 : polymorphic base A or G
aggcttgtccttgttttctctgcrttttatcagcctcatccaaagtt

SEQ ID NO: 3899 - DNA, 47 bp, Homo Sapiens
  allele 24: 99-889-153 : polymorphic base G or C
ctgaatgttttgcaaatggatctscaggcatgagggaaaccagcacg

SEQ ID NO: 3900 - DNA, 47 bp, Homo Sapiens
  allele 24: 99-9450-70 : polymorphic base A or T
tggcttgggcatggttttcagttwtgggtccttccttttgtgcggga

SEQ ID NO: 3901 - DNA, 47 bp, Homo Sapiens
  allele 24: 99-9609-220 : polymorphic base C or T
agctccctctttgttctccttgcyttcctcaaatatgggtctaaact

SEQ ID NO: 3902 - DNA, 47 bp, Homo Sapiens
  allele 24: 99-9612-324 : polymorphic base A or G
cctgccaaatattttaaaagccartttgtgatgcactaatatatgga

SEQ ID NO: 3903 - DNA, 47 bp, Homo Sapiens
  allele 24: 99-9616-136 : polymorphic base A or G
ggctccagccctctcataatctartttcatgccagcttcagagtcat

SEQ ID NO: 3904 - DNA, 47 bp, Homo Sapiens
  allele 24: 99-9683-49 : polymorphic base A or G
aaatatatgactcaaactgccatrtatttctcacttttcactcagga

SEQ ID NO: 3905 - DNA, 47 bp, Homo Sapiens
  allele 24: 99-9907-88 : polymorphic base C or T
agtttgactctcccctaacccagyagcctccttctttcatttcatat

SEQ ID NO: 3906 - DNA, 47 bp, Homo Sapiens
  allele 24: 99-993-218 : polymorphic base C or T
aggcaggccccacataactggaayccatattcacccttttgttcctc

SEQ ID NO: 3907 - DNA, 47 bp, Homo Sapiens
  allele 24: 99-24069-351 : polymorphic base C or T
ggagccacatgttattatccctgytttacagatgaaggaactaaagc

SEQ ID NO: 3908 - DNA, 47 bp, Homo Sapiens
  allele 24: 99-3855-279 : polymorphic base G or C
cagctcacctagtggcaatggctscaggtaagcgcccctaaaatccc

SEQ ID NO: 3909 - DNA, 47 bp, Homo Sapiens
  allele 24: 99-344-439 : polymorphic base G or A
tgctgccaaggatccatgtcagcrtgctcctctctgagccctggtct

SEQ ID NO: 3910 - DNA, 47 bp, Homo Sapiens
  allele 24: 99-366-274 : polymorphic base C or T
agggcctggcttcagggacagctyaggaaatgtttgttgagttagtg

SEQ ID NO: 3911 - DNA, 47 bp, Homo Sapiens
  allele 24: 99-359-308 : polymorphic base A or G
ctacagagtcatcgcctccatccrgtctcaacaaatcctggcagctc

SEQ ID NO: 3912 - DNA, 47 bp, Homo Sapiens
  allele 24: 99-355-219 : polymorphic base A or G
ggagtttcggggagtttcgggagrgttcctgggaagaagctcctccc

SEQ ID NO: 3913 - DNA, 47 bp, Homo Sapiens
  allele 24: 99-365-344 : polymorphic base C or T
cctaccaagcaagcagccccagcytagggtcagacagggtgagcctc

SEQ ID NO: 3914 - DNA, 47 bp, Homo Sapiens
  allele 24: 99-2452-54 : polymorphic base C or T
tgggcgcggacatggaggacgtgygcggccgcctggtgcagtaccgc

SEQ ID NO: 3915 - DNA, 47 bp, Homo Sapiens
  allele 24: 99-123-381 : polymorphic base C or T
tttctcatcctcacacctcactgygcccctcctgaacccactccttt

SEQ ID NO: 3916 - DNA, 47 bp, Homo Sapiens
  allele 24: 4-26-29 : polymorphic base A or G
  misc_feature 7: n=a, g, c or t
ccctgtnagacacgtcctgtatcrttgttgagatgggaaagtgcatc

SEQ ID NO: 3917 - DNA, 47 bp, Homo Sapiens
  allele 24: 4-14-240 : polymorphic base C or T
gcagggagcagaccagacatgatytgttctagtctagctgattcata

SEQ ID NO: 3918 - DNA, 47 bp, Homo Sapiens
  allele 24: 4-77-151 : polymorphic base G or C
gctgttcagactaaacttggagastacagtcagtcagagaacttgct

SEQ ID NO: 3919 - DNA, 47 bp, Homo Sapiens
  allele 24: 99-217-277 : polymorphic base C or T
atatagttcacgttatgttcatayttaattgttgcattttgtttgcc

SEQ ID NO: 3920 - DNA, 47 bp, Homo Sapiens
  allele 24: 4-67-40 : polymorphic base C or T
gccagtgaaatacagacttaattygtcatgactgaacgaatttgttt

SEQ ID NO: 3921 - DNA, 47 bp, Homo Sapiens
  allele 24: 99-213-164 : polymorphic base A or G
cccccaggggtggacaacaccagrgctcaggggcttgaatgctaagg

SEQ ID NO: 3922 - DNA, 47 bp, Homo Sapiens
  allele 24: 99-221-377 : polymorphic base A or C
agcttgagaaaccagaaaagccamaaggaggctcctaccacatgggt

SEQ ID NO: 3923 - DNA, 47 bp, Homo Sapiens
  allele 24: 99-135-196 : polymorphic base A or G
agtcactatatctatgtttaatgragatagaaagagatgcagaaatg

SEQ ID NO: 3924 - DNA, 47 bp, Homo Sapiens
  allele 24: 99-1482-32 : polymorphic base A or C
agtgaagtctgagggggaaaaatmaaccctatagagggaaggatctg

SEQ ID NO: 3925 - DNA, 47 bp, Homo Sapiens
  allele 24: 4-73-134 : polymorphic base G or C
gttttccttatgatgttacatggsttatttttaaaggtaatgaaaac

SEQ ID NO: 3926 - DNA, 47 bp, Homo Sapiens
  allele 24: 4-65-324 : polymorphic base C or T
ggtgctgctcagcggcttgcacgyagacttgctaggaagaaatgcag

SEQ ID NO: 3927 - DNA, 47 bp, Homo Sapiens
  allele 24: 10-32-357 : polymorphic base A or C
agaatggtaaggaaagcccttcamtcagggaagaacagaaggggaga

SEQ ID NO: 3928 - DNA, 47 bp, Homo Sapiens
  allele 24: 10-33-175 : polymorphic base T or C
agcaggacccagaatgggaggagyttccagaggaccggaacacttgc

SEQ ID NO: 3929 - DNA, 47 bp, Homo Sapiens
  allele 24: 10-33-234 : polymorphic base A or C
ctacactgccaagtgagtcctaamcctgatgttgctaataagtgggg

SEQ ID NO: 3930 - DNA, 47 bp, Homo Sapiens
  allele 24: 10-33-327 : polymorphic base C or T
accacatgtctgtctgagccaagyttctgagcgccagggaggtgagg

SEQ ID NO: 3931 - DNA, 47 bp, Homo Sapiens
  allele 24: 10-35-358 : polymorphic base G or C
cgtagcatccccttgggtgggagsgggaaggctgactaggacctctg

SEQ ID NO: 3932 - DNA, 47 bp, Homo Sapiens
  allele 24: 10-35-390 : polymorphic base T or C
tgactaggacctctgattcttctytccctgagctttgaaggctctga

SEQ ID NO: 3933 - DNA, 47 bp, Homo Sapiens
  allele 24: 10-36-164 : polymorphic base A or G
tactcttcctgttcctcatgtccrttgctggcatattcaactattac

SEQ ID NO: 3934 - DNA, 47 bp, Homo Sapiens
  allele 24: 10-204-326 : polymorphic base A or G
tctctggtgcctgtgctgggctcrtgctggtcatggtcttgggtcca

SEQ ID NO: 3935 - DNA, 19 bp, Homo Sapiens
  primer_bind 1..19: upstream amplification primer 99-109 for SEQ 1,
gaccataatctgctgattg

SEQ ID NO: 3936 - DNA, 19 bp, Homo Sapiens
  primer_bind 1..19: upstream amplification primer 99-1126 for SEQ 2,
cacatacttcaacccaaac

SEQ ID NO: 3937 - DNA, 18 bp, Homo Sapiens
  primer_bind 1..18: upstream amplification primer 99-114 for SEQ 3,
agcaaaagctgaacagtc

SEQ ID NO: 3938 - DNA, 18 bp, Homo Sapiens
  primer_bind 1..18: upstream amplification primer 99-1151 for SEQ 4,
aaaattaccaccctgtcc

SEQ ID NO: 3939 - DNA, 18 bp, Homo Sapiens
  primer_bind 1..18: upstream amplification primer 99-1165 for SEQ 5,
ctctttctctctgtcctc

SEQ ID NO: 3940 - DNA, 19 bp, Homo Sapiens
  primer_bind 1..19: upstream amplification primer 99-1167 for SEQ 6,
aatagtagtaaggtggtag

SEQ ID NO: 3941 - DNA, 18 bp, Homo Sapiens
  primer_bind 1..18: upstream amplification primer 99-117 for SEQ 7,
aaattcaagcctggggtc

SEQ ID NO: 3942 - DNA, 19 bp, Homo Sapiens
  primer_bind 1..19: upstream amplification primer 99-118 for SEQ 8,
attatttgaagcatctggg

SEQ ID NO: 3943 - DNA, 18 bp, Homo Sapiens
  primer_bind 1..18: upstream amplification primer 99-1217 for SEQ 9,
catttccacacacttgtc

SEQ ID NO: 3944 - DNA, 19 bp, Homo Sapiens
  primer_bind 1..19: upstream amplification primer 99-1233 for SEQ 10,
tattgtgctgggtaaattc

SEQ ID NO: 3945 - DNA, 19 bp, Homo Sapiens
  primer_bind 1..19: upstream amplification primer 99-12478 for SEQ 11,
caaagatgaaaggaccgag

SEQ ID NO: 3946 - DNA, 20 bp, Homo Sapiens
  primer_bind 1..20: upstream amplification primer 99-12487 for SEQ 12,
gtctcagcagttctacttac

SEQ ID NO: 3947 - DNA, 19 bp, Homo Sapiens
  primer_bind 1..19: upstream amplification primer 99-12497 for SEQ 13,
agactcatctttcacgaag

SEQ ID NO: 3948 - DNA, 19 bp, Homo Sapiens
  primer_bind 1..19: upstream amplification primer 99-12503 for SEQ 14,
cctggctcattcctttcac

SEQ ID NO: 3949 - DNA, 20 bp, Homo Sapiens
  primer_bind 1..20: upstream amplification primer 99-12504 for SEQ 15,
gttatatgagtaagacctgc

SEQ ID NO: 3950 - DNA, 19 bp, Homo Sapiens
  primer_bind 1..19: upstream amplification primer 99-12505 for SEQ 16,
gaatcttatctgcacaggg

SEQ ID NO: 3951 - DNA, 20 bp, Homo Sapiens
  primer_bind 1..20: upstream amplification primer 99-12506 for SEQ 17,
tgacagtgtgccttgtgtcc

SEQ ID NO: 3952 - DNA, 18 bp, Homo Sapiens
  primer_bind 1..18: upstream amplification primer 99-12509 for SEQ 18,
acctgcaatgtcccactc

SEQ ID NO: 3953 - DNA, 18 bp, Homo Sapiens
  primer_bind 1..18: upstream amplification primer 99-12513 for SEQ 19,
tttcggtggtttaagggg

SEQ ID NO: 3954 - DNA, 19 bp, Homo Sapiens
  primer_bind 1..19: upstream amplification primer 99-12514 for SEQ 20,
agcgaaggaggtgaaatgg

SEQ ID NO: 3955 - DNA, 21 bp, Homo Sapiens
  primer_bind 1..21: upstream amplification primer 99-12515 for SEQ 21,
gattggaagagtagtattttg

SEQ ID NO: 3956 - DNA, 20 bp, Homo Sapiens
  primer_bind 1..20: upstream amplification primer 99-12516 for SEQ 22,
ctaaccccctacttctttac

SEQ ID NO: 3957 - DNA, 20 bp, Homo Sapiens
  primer_bind 1..20: upstream amplification primer 99-12518 for SEQ 23,
aacacagtctcttgattgcc

SEQ ID NO: 3958 - DNA, 19 bp, Homo Sapiens
  primer_bind 1..19: upstream amplification primer 99-12523 for SEQ 24,
cccaggagaaaccacatac

SEQ ID NO: 3959 - DNA, 20 bp, Homo Sapiens
  primer_bind 1..20: upstream amplification primer 99-12525 for SEQ 25,
tcatcagtgaaggctgacgg

SEQ ID NO: 3960 - DNA, 20 bp, Homo Sapiens
  primer_bind 1..20: upstream amplification primer 99-12526 for SEQ 26,
ctttcttggatactgactac

SEQ ID NO: 3961 - DNA, 18 bp, Homo Sapiens
  primer_bind 1..18: upstream amplification primer 99-12527 for SEQ 27,
tggagacgttacacacac

SEQ ID NO: 3962 - DNA, 21 bp, Homo Sapiens
  primer_bind 1..21: upstream amplification primer 99-12531 for SEQ 28,
tgctttgtggaggctgatttg

SEQ ID NO: 3963 - DNA, 19 bp, Homo Sapiens
  primer_bind 1..19: upstream amplification primer 99-12532 for SEQ 29,
acagtacaagggggtgttc

SEQ ID NO: 3964 - DNA, 18 bp, Homo Sapiens
  primer_bind 1..18: upstream amplification primer 99-12534 for SEQ 30,
taggggagttacctaatg

SEQ ID NO: 3965 - DNA, 18 bp, Homo Sapiens
  primer_bind 1..18: upstream amplification primer 99-12535 for SEQ 31,
gagggataggatagcaag

SEQ ID NO: 3966 - DNA, 21 bp, Homo Sapiens
  primer_bind 1..21: upstream amplification primer 99-12537 for SEQ 32,
gaccttggttggggaaaaatg

SEQ ID NO: 3967 - DNA, 21 bp, Homo Sapiens
  primer_bind 1..21: upstream amplification primer 99-12538 for SEQ 33,
cctgctcaatagagtattttg

SEQ ID NO: 3968 - DNA, 21 bp, Homo Sapiens
  primer_bind 1..21: upstream amplification primer 99-12539 for SEQ 34,
aaggatgggggaagagaaagg

SEQ ID NO: 3969 - DNA, 19 bp, Homo Sapiens
  primer_bind 1..19: upstream amplification primer 99-12540 for SEQ 35,
ttcagcttaacggtacaac

SEQ ID NO: 3970 - DNA, 19 bp, Homo Sapiens
  primer_bind 1..19: upstream amplification primer 99-12541 for SEQ 36,
ctaaattctcatggcacac

SEQ ID NO: 3971 - DNA, 19 bp, Homo Sapiens
  primer_bind 1..19: upstream amplification primer 99-12545 for SEQ 37,
ttctgcttgaggtgactgc

SEQ ID NO: 3972 - DNA, 20 bp, Homo Sapiens
  primer_bind 1..20: upstream amplification primer 99-12548 for SEQ 38,
agggacccagagccttttac

SEQ ID NO: 3973 - DNA, 20 bp, Homo Sapiens
  primer_bind 1..20: upstream amplification primer 99-12558 for SEQ 39,
ggtatgttttggcgaatgtg

SEQ ID NO: 3974 - DNA, 19 bp, Homo Sapiens
  primer_bind 1..19: upstream amplification primer 99-12562 for SEQ 40,
atgatgtcgttcccccttg

SEQ ID NO: 3975 - DNA, 19 bp, Homo Sapiens
  primer_bind 1..19: upstream amplification primer 99-12564 for SEQ 41,
gatgagagcagatgacaag

SEQ ID NO: 3976 - DNA, 19 bp, Homo Sapiens
  primer_bind 1..19: upstream amplification primer 99-12565 for SEQ 42,
ccaaggcaggaatatgtag

SEQ ID NO: 3977 - DNA, 19 bp, Homo Sapiens
  primer_bind 1..19: upstream amplification primer 99-12575 for SEQ 43,
ccctgctgtgataaatgtg

SEQ ID NO: 3978 - DNA, 20 bp, Homo Sapiens
  primer_bind 1..20: upstream amplification primer 99-12576 for SEQ 44,
agtggcaagcactgtttccg

SEQ ID NO: 3979 - DNA, 21 bp, Homo Sapiens
  primer_bind 1..21: upstream amplification primer 99-12580 for SEQ 45,
gttttcaggtttattcgacag

SEQ ID NO: 3980 - DNA, 20 bp, Homo Sapiens
  primer_bind 1..20: upstream amplification primer 99-12585 for SEQ 46,
tcaactgaggtccactgagg

SEQ ID NO: 3981 - DNA, 19 bp, Homo Sapiens
  primer_bind 1..19: upstream amplification primer 99-12593 for SEQ 47,
gtttgctgctttcattggc

SEQ ID NO: 3982 - DNA, 20 bp, Homo Sapiens
  primer_bind 1..20: upstream amplification primer 99-12600 for SEQ 48,
cacaactccgctaatatgcc

SEQ ID NO: 3983 - DNA, 18 bp, Homo Sapiens
  primer_bind 1..18: upstream amplification primer 99-12608 for SEQ 49,
agcgtcttgaactttccc

SEQ ID NO: 3984 - DNA, 19 bp, Homo Sapiens
  primer_bind 1..19: upstream amplification primer 99-12610 for SEQ 50,
tactgcaatacattagacc

SEQ ID NO: 3985 - DNA, 21 bp, Homo Sapiens
  primer_bind 1..21: upstream amplification primer 99-12611 for SEQ 51,
agcatgaaagcataaaatacc

SEQ ID NO: 3986 - DNA, 19 bp, Homo Sapiens
  primer_bind 1..19: upstream amplification primer 99-12613 for SEQ 52,
gccattagccaggattaag

SEQ ID NO: 3987 - DNA, 19 bp, Homo Sapiens
  primer_bind 1..19: upstream amplification primer 99-12615 for SEQ 53,
tgtaaaactggaatgtgac

SEQ ID NO: 3988 - DNA, 19 bp, Homo Sapiens
  primer_bind 1..19: upstream amplification primer 99-12617 for SEQ 54,
caaaaagccaatatgccac

SEQ ID NO: 3989 - DNA, 18 bp, Homo Sapiens
  primer_bind 1..18: upstream amplification primer 99-12618 for SEQ 55,
gagcacttggacgtggac

SEQ ID NO: 3990 - DNA, 18 bp, Homo Sapiens
  primer_bind 1..18: upstream amplification primer 99-12619 for SEQ 56,
gagcactgaaaataagcc

SEQ ID NO: 3991 - DNA, 19 bp, Homo Sapiens
  primer_bind 1..19: upstream amplification primer 99-12621 for SEQ 57,
aaggcttgccgacgttttc

SEQ ID NO: 3992 - DNA, 20 bp, Homo Sapiens
  primer_bind 1..20: upstream amplification primer 99-12624 for SEQ 58,
gtctagttacaacagacttc

SEQ ID NO: 3993 - DNA, 19 bp, Homo Sapiens
  primer_bind 1..19: upstream amplification primer 99-1263 for SEQ 59,
gaaaatactacctgactac

SEQ ID NO: 3994 - DNA, 20 bp, Homo Sapiens
  primer_bind 1..20: upstream amplification primer 99-12632 for SEQ 60,
ctttgtaaagcatctagggg

SEQ ID NO: 3995 - DNA, 21 bp, Homo Sapiens
  primer_bind 1..21: upstream amplification primer 99-12637 for SEQ 61,
caactctctaaaattgtttcc

SEQ ID NO: 3996 - DNA, 20 bp, Homo Sapiens
  primer_bind 1..20: upstream amplification primer 99-12639 for SEQ 62,
ttgggcagctttgcagtgtc

SEQ ID NO: 3997 - DNA, 20 bp, Homo Sapiens
  primer_bind 1..20: upstream amplification primer 99-12640 for SEQ 63,
gggatgatctttgtttcctg

SEQ ID NO: 3998 - DNA, 21 bp, Homo Sapiens
  primer_bind 1..21: upstream amplification primer 99-12650 for SEQ 64,
atccttatcatcatcttcatc

SEQ ID NO: 3999 - DNA, 19 bp, Homo Sapiens
  primer_bind 1..19: upstream amplification primer 99-12651 for SEQ 65,
cagatataacagagtcggg

SEQ ID NO: 4000 - DNA, 20 bp, Homo Sapiens
  primer_bind 1..20: upstream amplification primer 99-12652 for SEQ 66,
ctactatcacttccttaaac

SEQ ID NO: 4001 - DNA, 18 bp, Homo Sapiens
  primer_bind 1..18: upstream amplification primer 99-12654 for SEQ 67,
caggcttaaaacgctgac

SEQ ID NO: 4002 - DNA, 20 bp, Homo Sapiens
  primer_bind 1..20: upstream amplification primer 99-12656 for SEQ 68,
ctgtgggcttcttttcattg

SEQ ID NO: 4003 - DNA, 21 bp, Homo Sapiens
  primer_bind 1..21: upstream amplification primer 99-12658 for SEQ 69,
ccaagatcaaatatcactttc

SEQ ID NO: 4004 - DNA, 21 bp, Homo Sapiens
  primer_bind 1..21: upstream amplification primer 99-12661 for SEQ 70,
gaataaaggtcttacttcttg

SEQ ID NO: 4005 - DNA, 21 bp, Homo Sapiens
  primer_bind 1..21: upstream amplification primer 99-12668 for SEQ 71,
gtaatttagatattagccacc

SEQ ID NO: 4006 - DNA, 20 bp, Homo Sapiens
  primer_bind 1..20: upstream amplification primer 99-1268 for SEQ 72,
gcaagattgtcaaccaaaag

SEQ ID NO: 4007 - DNA, 20 bp, Homo Sapiens
  primer_bind 1..20: upstream amplification primer 99-12733 for SEQ 73,
ctctctgagatcattagctg

SEQ ID NO: 4008 - DNA, 20 bp, Homo Sapiens
  primer_bind 1..20: upstream amplification primer 99-12738 for SEQ 74,
gtgaaatatctgtttgtgtg

SEQ ID NO: 4009 - DNA, 18 bp, Homo Sapiens
  primer_bind 1..18: upstream amplification primer 99-12740 for SEQ 75,
gccgctaactatcaacag

SEQ ID NO: 4010 - DNA, 21 bp, Homo Sapiens
  primer_bind 1..21: upstream amplification primer 99-12749 for SEQ 76,
cgatgtggagtcttttgtatg

SEQ ID NO: 4011 - DNA, 20 bp, Homo Sapiens
  primer_bind 1..20: upstream amplification primer 99-12750 for SEQ 77,
acgggatgactgggtacaac

SEQ ID NO: 4012 - DNA, 21 bp, Homo Sapiens
  primer_bind 1..21: upstream amplification primer 99-12751 for SEQ 78,
gaacactctattaaggtaaag

SEQ ID NO: 4013 - DNA, 19 bp, Homo Sapiens
  primer_bind 1..19: upstream amplification primer 99-12755 for SEQ 79,
tgatggtgagtataggatg

SEQ ID NO: 4014 - DNA, 21 bp, Homo Sapiens
  primer_bind 1..21: upstream amplification primer 99-12756 for SEQ 80,
ctcagtgacttcatttgattc

SEQ ID NO: 4015 - DNA, 20 bp, Homo Sapiens
  primer_bind 1..20: upstream amplification primer 99-12757 for SEQ 81,
gctgaaaataaatccttgtg

SEQ ID NO: 4016 - DNA, 18 bp, Homo Sapiens
  primer_bind 1..18: upstream amplification primer 99-12759 for SEQ 82,
gtaagattgggtgcattc

SEQ ID NO: 4017 - DNA, 18 bp, Homo Sapiens
  primer_bind 1..18: upstream amplification primer 99-12777 for SEQ 83,
cagagggttaattccgag

SEQ ID NO: 4018 - DNA, 18 bp, Homo Sapiens
  primer_bind 1..18: upstream amplification primer 99-12782 for SEQ 84,
gttgtgacactatgaccc

SEQ ID NO: 4019 - DNA, 19 bp, Homo Sapiens
  primer_bind 1..19: upstream amplification primer 99-12794 for SEQ 85,
aattatccacaacgtgttc

SEQ ID NO: 4020 - DNA, 18 bp, Homo Sapiens
  primer_bind 1..18: upstream amplification primer 99-128 for SEQ 86,
gaccagggtttaagttag

SEQ ID NO: 4021 - DNA, 19 bp, Homo Sapiens
  primer_bind 1..19: upstream amplification primer 99-12816 for SEQ 87,
cttggttgatattagcctg

SEQ ID NO: 4022 - DNA, 21 bp, Homo Sapiens
  primer_bind 1..21: upstream amplification primer 99-12817 for SEQ 88,
cgtattctgccattccttttc

SEQ ID NO: 4023 - DNA, 20 bp, Homo Sapiens
  primer_bind 1..20: upstream amplification primer 99-12819 for SEQ 89,
gcagatcaatgtaaaggcag

SEQ ID NO: 4024 - DNA, 19 bp, Homo Sapiens
  primer_bind 1..19: upstream amplification primer 99-12826 for SEQ 90,
gctatacttcctgtcttcc

SEQ ID NO: 4025 - DNA, 19 bp, Homo Sapiens
  primer_bind 1..19: upstream amplification primer 99-12831 for SEQ 91,
atggtccaacacggtcttc

SEQ ID NO: 4026 - DNA, 18 bp, Homo Sapiens
  primer_bind 1..18: upstream amplification primer 99-12836 for SEQ 92,
gtgtctctagcatacctc

SEQ ID NO: 4027 - DNA, 21 bp, Homo Sapiens
  primer_bind 1..21: upstream amplification primer 99-12842 for SEQ 93,
gcaacacaaattactgaagcc

SEQ ID NO: 4028 - DNA, 19 bp, Homo Sapiens
  primer_bind 1..19: upstream amplification primer 99-12843 for SEQ 94,
agaaatgcgttgagaattg

SEQ ID NO: 4029 - DNA, 18 bp, Homo Sapiens
  primer_bind 1..18: upstream amplification primer 99-12844 for SEQ 95,
attctcgcctaaaacccc

SEQ ID NO: 4030 - DNA, 19 bp, Homo Sapiens
  primer_bind 1..19: upstream amplification primer 99-12847 for SEQ 96,
ctccgttcctatttctctg

SEQ ID NO: 4031 - DNA, 18 bp, Homo Sapiens
  primer_bind 1..18: upstream amplification primer 99-12848 for SEQ 97,
cttttcgccttgatctcc

SEQ ID NO: 4032 - DNA, 19 bp, Homo Sapiens
  primer_bind 1..19: upstream amplification primer 99-12852 for SEQ 98,
aaagcaacagtcaagtatc

SEQ ID NO: 4033 - DNA, 21 bp, Homo Sapiens
  primer_bind 1..21: upstream amplification primer 99-12856 for SEQ 99,
gaggcatgagatgtatcgtcc

SEQ ID NO: 4034 - DNA, 21 bp, Homo Sapiens
  primer_bind 1..21: upstream amplification primer 99-12878 for SEQ 100,
gtaaatagtccttcactgtag

SEQ ID NO: 4035 - DNA, 20 bp, Homo Sapiens
  primer_bind 1..20: upstream amplification primer 99-12880 for SEQ 101,
agcctggaatatgggtagcc

SEQ ID NO: 4036 - DNA, 20 bp, Homo Sapiens
  primer_bind 1..20: upstream amplification primer 99-12884 for SEQ 102,
ctggaagaaggtaataacac

SEQ ID NO: 4037 - DNA, 18 bp, Homo Sapiens
  primer_bind 1..18: upstream amplification primer 99-12885 for SEQ 103,
cagagcgtgtttaaatgg

SEQ ID NO: 4038 - DNA, 20 bp, Homo Sapiens
  primer_bind 1..20: upstream amplification primer 99-12898 for SEQ 104,
ctactctcagcctctaaaac

SEQ ID NO: 4039 - DNA, 21 bp, Homo Sapiens
  primer_bind 1..21: upstream amplification primer 99-12899 for SEQ 105,
ggtgtgcgattgagatttttg

SEQ ID NO: 4040 - DNA, 18 bp, Homo Sapiens
  primer_bind 1..18: upstream amplification primer 99-1290 for SEQ 106,
cagtcgctcatgttatcc

SEQ ID NO: 4041 - DNA, 18 bp, Homo Sapiens
  primer_bind 1..18: upstream amplification primer 99-12900 for SEQ 107,
ctccttcctagcgataac

SEQ ID NO: 4042 - DNA, 21 bp, Homo Sapiens
  primer_bind 1..21: upstream amplification primer 99-12901 for SEQ 108,
gtagatgattcatacccaacc

SEQ ID NO: 4043 - DNA, 21 bp, Homo Sapiens
  primer_bind 1..21: upstream amplification primer 99-12903 for SEQ 109,
atgtaatgtattcagcgagcc

SEQ ID NO: 4044 - DNA, 18 bp, Homo Sapiens
  primer_bind 1..18: upstream amplification primer 99-12907 for SEQ 110,
tctgttaggacctgtgag

SEQ ID NO: 4045 - DNA, 21 bp, Homo Sapiens
  primer_bind 1..21: upstream amplification primer 99-12908 for SEQ 111,
gaacaaaagtaatgtgttcag

SEQ ID NO: 4046 - DNA, 18 bp, Homo Sapiens
  primer_bind 1..18: upstream amplification primer 99-12913 for SEQ 112,
ccaagccacaattaatcc

SEQ ID NO: 4047 - DNA, 19 bp, Homo Sapiens
  primer_bind 1..19: upstream amplification primer 99-12914 for SEQ 113,
ctgaaagaataggagagtc

SEQ ID NO: 4048 - DNA, 19 bp, Homo Sapiens
  primer_bind 1..19: upstream amplification primer 99-12924 for SEQ 114,
cctgtgttcaatcaagttc

SEQ ID NO: 4049 - DNA, 18 bp, Homo Sapiens
  primer_bind 1..18: upstream amplification primer 99-12925 for SEQ 115,
acattgactgctctgtcc

SEQ ID NO: 4050 - DNA, 19 bp, Homo Sapiens
  primer_bind 1..19: upstream amplification primer 99-12926 for SEQ 116,
atgcacagagcaataaaag

SEQ ID NO: 4051 - DNA, 20 bp, Homo Sapiens
  primer_bind 1..20: upstream amplification primer 99-12931 for SEQ 117,
ccaatctcatcttccccctc

SEQ ID NO: 4052 - DNA, 19 bp, Homo Sapiens
  primer_bind 1..19: upstream amplification primer 99-12948 for SEQ 118,
tgcctttaccttcacccag

SEQ ID NO: 4053 - DNA, 19 bp, Homo Sapiens
  primer_bind 1..19: upstream amplification primer 99-12952 for SEQ 119,
acccaccaattcctctctg

SEQ ID NO: 4054 - DNA, 18 bp, Homo Sapiens
  primer_bind 1..18: upstream amplification primer 99-12956 for SEQ 120,
cttaccgcttccaaacac

SEQ ID NO: 4055 - DNA, 20 bp, Homo Sapiens
  primer_bind 1..20: upstream amplification primer 99-12957 for SEQ 121,
tgaccaccctggtgacattc

SEQ ID NO: 4056 - DNA, 20 bp, Homo Sapiens
  primer_bind 1..20: upstream amplification primer 99-12961 for SEQ 122,
gagtaaacggaatgttttgg

SEQ ID NO: 4057 - DNA, 20 bp, Homo Sapiens
  primer_bind 1..20: upstream amplification primer 99-12962 for SEQ 123,
aagccgcagtgtttccagag

SEQ ID NO: 4058 - DNA, 19 bp, Homo Sapiens
  primer_bind 1..19: upstream amplification primer 99-12963 for SEQ 124,
aggtgtgaatggatctggg

SEQ ID NO: 4059 - DNA, 19 bp, Homo Sapiens
  primer_bind 1..19: upstream amplification primer 99-12964 for SEQ 125,
ctctctgtaaccaataacc

SEQ ID NO: 4060 - DNA, 19 bp, Homo Sapiens
  primer_bind 1..19: upstream amplification primer 99-13021 for SEQ 126,
tgagatgtataatgaggtg

SEQ ID NO: 4061 - DNA, 20 bp, Homo Sapiens
  primer_bind 1..20: upstream amplification primer 99-13036 for SEQ 127,
agaggggacagagaaaggac

SEQ ID NO: 4062 - DNA, 19 bp, Homo Sapiens
  primer_bind 1..19: upstream amplification primer 99-13045 for SEQ 128,
aatttgaacacagagacag

SEQ ID NO: 4063 - DNA, 21 bp, Homo Sapiens
  primer_bind 1..21: upstream amplification primer 99-13051 for SEQ 129,
gttttcccaagcatagagttc

SEQ ID NO: 4064 - DNA, 18 bp, Homo Sapiens
  primer_bind 1..18: upstream amplification primer 99-13061 for SEQ 130,
cctgatagtcattttgcc

SEQ ID NO: 4065 - DNA, 19 bp, Homo Sapiens
  primer_bind 1..19: upstream amplification primer 99-13064 for SEQ 131,
agtacctaatctaagtacc

SEQ ID NO: 4066 - DNA, 18 bp, Homo Sapiens
  primer_bind 1..18: upstream amplification primer 99-13065 for SEQ 132,
tggagacaaaaaggaggg

SEQ ID NO: 4067 - DNA, 19 bp, Homo Sapiens
  primer_bind 1..19: upstream amplification primer 99-13070 for SEQ 133,
ggtgattgtggaagagatg

SEQ ID NO: 4068 - DNA, 21 bp, Homo Sapiens
  primer_bind 1..21: upstream amplification primer 99-13098 for SEQ 134,
gagagatttccaaccacttac

SEQ ID NO: 4069 - DNA, 18 bp, Homo Sapiens
  primer_bind 1..18: upstream amplification primer 99-13106 for SEQ 135,
agccacctattaaactcc

SEQ ID NO: 4070 - DNA, 20 bp, Homo Sapiens
  primer_bind 1..20: upstream amplification primer 99-13115 for SEQ 136,
ggttcatagacataattctg

SEQ ID NO: 4071 - DNA, 20 bp, Homo Sapiens
  primer_bind 1..20: upstream amplification primer 99-13121 for SEQ 137,
actttagtcaactctcactc

SEQ ID NO: 4072 - DNA, 18 bp, Homo Sapiens
  primer_bind 1..18: upstream amplification primer 99-13130 for SEQ 138,
atagagtgagtatgctgg

SEQ ID NO: 4073 - DNA, 18 bp, Homo Sapiens
  primer_bind 1..18: upstream amplification primer 99-13133 for SEQ 139,
tctggcacttctcctaac

SEQ ID NO: 4074 - DNA, 18 bp, Homo Sapiens
  primer_bind 1..18: upstream amplification primer 99-13134 for SEQ 140,
gatggtttctttgggagg

SEQ ID NO: 4075 - DNA, 19 bp, Homo Sapiens
  primer_bind 1..19: upstream amplification primer 99-13165 for SEQ 141,
ctagggctatttctgtaac

SEQ ID NO: 4076 - DNA, 19 bp, Homo Sapiens
  primer_bind 1..19: upstream amplification primer 99-13178 for SEQ 142,
gccaagttgtgtaaattcc

SEQ ID NO: 4077 - DNA, 18 bp, Homo Sapiens
  primer_bind 1..18: upstream amplification primer 99-13192 for SEQ 143,
atctactgggaatgactg

SEQ ID NO: 4078 - DNA, 19 bp, Homo Sapiens
  primer_bind 1..19: upstream amplification primer 99-13193 for SEQ 144,
cctcctaatacttaaatcc

SEQ ID NO: 4079 - DNA, 18 bp, Homo Sapiens
  primer_bind 1..18: upstream amplification primer 99-13201 for SEQ 145,
aaggcttcaacttcttgg

SEQ ID NO: 4080 - DNA, 18 bp, Homo Sapiens
  primer_bind 1..18: upstream amplification primer 99-13203 for SEQ 146,
tttacctcatccacacac

SEQ ID NO: 4081 - DNA, 18 bp, Homo Sapiens
  primer_bind 1..18: upstream amplification primer 99-13215 for SEQ 147,
gagagatggtttttgagg

SEQ ID NO: 4082 - DNA, 18 bp, Homo Sapiens
  primer_bind 1..18: upstream amplification primer 99-13218 for SEQ 148,
ccaggaaattccacagag

SEQ ID NO: 4083 - DNA, 18 bp, Homo Sapiens
  primer_bind 1..18: upstream amplification primer 99-13219 for SEQ 149,
tgaagaaagaggcggatg

SEQ ID NO: 4084 - DNA, 18 bp, Homo Sapiens
  primer_bind 1..18: upstream amplification primer 99-13222 for SEQ 150,
gcagacaacacttctcac

SEQ ID NO: 4085 - DNA, 20 bp, Homo Sapiens
  primer_bind 1..20: upstream amplification primer 99-13224 for SEQ 151,
ctaatggcaaaaggtatcac

SEQ ID NO: 4086 - DNA, 18 bp, Homo Sapiens
  primer_bind 1..18: upstream amplification primer 99-13227 for SEQ 152,
aggctaatactggcttgg

SEQ ID NO: 4087 - DNA, 20 bp, Homo Sapiens
  primer_bind 1..20: upstream amplification primer 99-13229 for SEQ 153,
ggagaaaaacaacttggaag

SEQ ID NO: 4088 - DNA, 19 bp, Homo Sapiens
  primer_bind 1..19: upstream amplification primer 99-13232 for SEQ 154,
gaataagaaggaaagacag

SEQ ID NO: 4089 - DNA, 19 bp, Homo Sapiens
  primer_bind 1..19: upstream amplification primer 99-13237 for SEQ 155,
aacattcccttttatcacc

SEQ ID NO: 4090 - DNA, 18 bp, Homo Sapiens
  primer_bind 1..18: upstream amplification primer 99-13238 for SEQ 156,
gcaggtggcatggacttg

SEQ ID NO: 4091 - DNA, 20 bp, Homo Sapiens
  primer_bind 1..20: upstream amplification primer 99-13241 for SEQ 157,
cctattctctaacccaaatc

SEQ ID NO: 4092 - DNA, 18 bp, Homo Sapiens
  primer_bind 1..18: upstream amplification primer 99-13246 for SEQ 158,
actctctgagctgaagac

SEQ ID NO: 4093 - DNA, 18 bp, Homo Sapiens
  primer_bind 1..18: upstream amplification primer 99-13250 for SEQ 159,
tttctcacgctatctgcc

SEQ ID NO: 4094 - DNA, 18 bp, Homo Sapiens
  primer_bind 1..18: upstream amplification primer 99-13251 for SEQ 160,
tgccataaacttggtgtc

SEQ ID NO: 4095 - DNA, 18 bp, Homo Sapiens
  primer_bind 1..18: upstream amplification primer 99-13258 for SEQ 161,
agtcaaaacccagaaccc

SEQ ID NO: 4096 - DNA, 20 bp, Homo Sapiens
  primer_bind 1..20: upstream amplification primer 99-13260 for SEQ 162,
tctcaatgagcctcctctcc

SEQ ID NO: 4097 - DNA, 18 bp, Homo Sapiens
  primer_bind 1..18: upstream amplification primer 99-13262 for SEQ 163,
ctctcatccttgtgtctc

SEQ ID NO: 4098 - DNA, 19 bp, Homo Sapiens
  primer_bind 1..19: upstream amplification primer 99-13269 for SEQ 164,
gtaattggctttgttgttg

SEQ ID NO: 4099 - DNA, 19 bp, Homo Sapiens
  primer_bind 1..19: upstream amplification primer 99-13270 for SEQ 165,
tcacctgtttccccctttc

SEQ ID NO: 4100 - DNA, 20 bp, Homo Sapiens
  primer_bind 1..20: upstream amplification primer 99-13271 for SEQ 166,
gcaaaaattgagcagagtgg

SEQ ID NO: 4101 - DNA, 18 bp, Homo Sapiens
  primer_bind 1..18: upstream amplification primer 99-13272 for SEQ 167,
tgtgaggaatgtagatgg

SEQ ID NO: 4102 - DNA, 18 bp, Homo Sapiens
  primer_bind 1..18: upstream amplification primer 99-13273 for SEQ 168,
atgtctggtgtctctgtg

SEQ ID NO: 4103 - DNA, 18 bp, Homo Sapiens
  primer_bind 1..18: upstream amplification primer 99-13276 for SEQ 169,
aaaggcttatggaactgg

SEQ ID NO: 4104 - DNA, 19 bp, Homo Sapiens
  primer_bind 1..19: upstream amplification primer 99-13279 for SEQ 170,
ctttattcagtgtatcctc

SEQ ID NO: 4105 - DNA, 18 bp, Homo Sapiens
  primer_bind 1..18: upstream amplification primer 99-13286 for SEQ 171,
tccttcttcttaatcccc

SEQ ID NO: 4106 - DNA, 18 bp, Homo Sapiens
  primer_bind 1..18: upstream amplification primer 99-13287 for SEQ 172,
tgtgcttgtcttgagacc

SEQ ID NO: 4107 - DNA, 18 bp, Homo Sapiens
  primer_bind 1..18: upstream amplification primer 99-13294 for SEQ 173,
ggagagagactaagtgtg

SEQ ID NO: 4108 - DNA, 19 bp, Homo Sapiens
  primer_bind 1..19: upstream amplification primer 99-13296 for SEQ 174,
ctattttgcactcttacgg

SEQ ID NO: 4109 - DNA, 20 bp, Homo Sapiens
  primer_bind 1..20: upstream amplification primer 99-13320 for SEQ 175,
ctatgtctgtgttgtgatgc

SEQ ID NO: 4110 - DNA, 18 bp, Homo Sapiens
  primer_bind 1..18: upstream amplification primer 99-13332 for SEQ 176,
gtgcagttgaggcttttc

SEQ ID NO: 4111 - DNA, 19 bp, Homo Sapiens
  primer_bind 1..19: upstream amplification primer 99-13334 for SEQ 177,
tcttgccctgccttattcc

SEQ ID NO: 4112 - DNA, 18 bp, Homo Sapiens
  primer_bind 1..18: upstream amplification primer 99-13336 for SEQ 178,
ttcttccactcagttgcc

SEQ ID NO: 4113 - DNA, 19 bp, Homo Sapiens
  primer_bind 1..19: upstream amplification primer 99-13339 for SEQ 179,
gaaactgattcttatagcc

SEQ ID NO: 4114 - DNA, 20 bp, Homo Sapiens
  primer_bind 1..20: upstream amplification primer 99-13354 for SEQ 180,
ctgaagatgtcacaaatgcc

SEQ ID NO: 4115 - DNA, 19 bp, Homo Sapiens
  primer_bind 1..19: upstream amplification primer 99-13368 for SEQ 181,
tactagaatcacgagatcc

SEQ ID NO: 4116 - DNA, 19 bp, Homo Sapiens
  primer_bind 1..19: upstream amplification primer 99-13394 for SEQ 182,
tgtagattgctttagaagg

SEQ ID NO: 4117 - DNA, 18 bp, Homo Sapiens
  primer_bind 1..18: upstream amplification primer 99-13395 for SEQ 183,
ccttatatccctaccatc

SEQ ID NO: 4118 - DNA, 18 bp, Homo Sapiens
  primer_bind 1..18: upstream amplification primer 99-13396 for SEQ 184,
tagcatcaactacatgcc

SEQ ID NO: 4119 - DNA, 18 bp, Homo Sapiens
  primer_bind 1..18: upstream amplification primer 99-134 for SEQ 185,
tggaaaggtactcagaag

SEQ ID NO: 4120 - DNA, 18 bp, Homo Sapiens
  primer_bind 1..18: upstream amplification primer 99-13401 for SEQ 186,
cccttaggaccatttcac

SEQ ID NO: 4121 - DNA, 18 bp, Homo Sapiens
  primer_bind 1..18: upstream amplification primer 99-13404 for SEQ 187,
tctgttgtcccatacttc

SEQ ID NO: 4122 - DNA, 18 bp, Homo Sapiens
  primer_bind 1..18: upstream amplification primer 99-13406 for SEQ 188,
gacatttatgcaactccc

SEQ ID NO: 4123 - DNA, 20 bp, Homo Sapiens
  primer_bind 1..20: upstream amplification primer 99-1342 for SEQ 189,
ccacacataatctcatttag

SEQ ID NO: 4124 - DNA, 18 bp, Homo Sapiens
  primer_bind 1..18: upstream amplification primer 99-13429 for SEQ 190,
actttctctgtctctgtg

SEQ ID NO: 4125 - DNA, 20 bp, Homo Sapiens
  primer_bind 1..20: upstream amplification primer 99-13439 for SEQ 191,
cttcctctactttcctcttg

SEQ ID NO: 4126 - DNA, 18 bp, Homo Sapiens
  primer_bind 1..18: upstream amplification primer 99-13443 for SEQ 192,
cggcactaaaaaggttcc

SEQ ID NO: 4127 - DNA, 18 bp, Homo Sapiens
  primer_bind 1..18: upstream amplification primer 99-13450 for SEQ 193,
gtagtcccctattatctg

SEQ ID NO: 4128 - DNA, 18 bp, Homo Sapiens
  primer_bind 1..18: upstream amplification primer 99-13457 for SEQ 194,
ggactttggatgatgatg

SEQ ID NO: 4129 - DNA, 19 bp, Homo Sapiens
  primer_bind 1..19: upstream amplification primer 99-1346 for SEQ 195,
cttattcaagcacctctac

SEQ ID NO: 4130 - DNA, 18 bp, Homo Sapiens
  primer_bind 1..18: upstream amplification primer 99-13462 for SEQ 196,
agggtgagaaactgatgg

SEQ ID NO: 4131 - DNA, 20 bp, Homo Sapiens
  primer_bind 1..20: upstream amplification primer 99-13486 for SEQ 197,
gctgaaatatgatcctccac

SEQ ID NO: 4132 - DNA, 20 bp, Homo Sapiens
  primer_bind 1..20: upstream amplification primer 99-13489 for SEQ 198,
gaccctaaacattttgctcc

SEQ ID NO: 4133 - DNA, 19 bp, Homo Sapiens
  primer_bind 1..19: upstream amplification primer 99-13499 for SEQ 199,
tgagacttaatgctgattc

SEQ ID NO: 4134 - DNA, 19 bp, Homo Sapiens
  primer_bind 1..19: upstream amplification primer 99-13502 for SEQ 200,
aggtggcaagcaggtttag

SEQ ID NO: 4135 - DNA, 20 bp, Homo Sapiens
  primer_bind 1..20: upstream amplification primer 99-13509 for SEQ 201,
ctggaaaacctaataatctg

SEQ ID NO: 4136 - DNA, 18 bp, Homo Sapiens
  primer_bind 1..18: upstream amplification primer 99-1351 for SEQ 202,
agtgggaaagggaagatg

SEQ ID NO: 4137 - DNA, 21 bp, Homo Sapiens
  primer_bind 1..21: upstream amplification primer 99-13515 for SEQ 203,
gaaaaccagtgtttgacagag

SEQ ID NO: 4138 - DNA, 18 bp, Homo Sapiens
  primer_bind 1..18: upstream amplification primer 99-13525 for SEQ 204,
cattgtaatcgtatgccc

SEQ ID NO: 4139 - DNA, 21 bp, Homo Sapiens
  primer_bind 1..21: upstream amplification primer 99-13526 for SEQ 205,
gaagttgcctattcttgtttg

SEQ ID NO: 4140 - DNA, 19 bp, Homo Sapiens
  primer_bind 1..19: upstream amplification primer 99-13531 for SEQ 206,
attcaaggggctatggcag

SEQ ID NO: 4141 - DNA, 18 bp, Homo Sapiens
  primer_bind 1..18: upstream amplification primer 99-13536 for SEQ 207,
tacagcttaactcacagg

SEQ ID NO: 4142 - DNA, 19 bp, Homo Sapiens
  primer_bind 1..19: upstream amplification primer 99-13540 for SEQ 208,
tgtgtccaaaaatgcttcc

SEQ ID NO: 4143 - DNA, 21 bp, Homo Sapiens
  primer_bind 1..21: upstream amplification primer 99-13541 for SEQ 209,
cttatcattcaaacctactcc

SEQ ID NO: 4144 - DNA, 18 bp, Homo Sapiens
  primer_bind 1..18: upstream amplification primer 99-13545 for SEQ 210,
cagtatctagtgagcacc

SEQ ID NO: 4145 - DNA, 21 bp, Homo Sapiens
  primer_bind 1..21: upstream amplification primer 99-13552 for SEQ 211,
acttcaaaataaggggggtgg

SEQ ID NO: 4146 - DNA, 19 bp, Homo Sapiens
  primer_bind 1..19: upstream amplification primer 99-13553 for SEQ 212,
aggtagaggttgggaatag

SEQ ID NO: 4147 - DNA, 19 bp, Homo Sapiens
  primer_bind 1..19: upstream amplification primer 99-13555 for SEQ 213,
gagtctaagtctatgttgg

SEQ ID NO: 4148 - DNA, 18 bp, Homo Sapiens
  primer_bind 1..18: upstream amplification primer 99-1356 for SEQ 214,
cctatcagtgagttttcc

SEQ ID NO: 4149 - DNA, 21 bp, Homo Sapiens
  primer_bind 1..21: upstream amplification primer 99-13567 for SEQ 215,
gagctagtagtcaaattatac

SEQ ID NO: 4150 - DNA, 21 bp, Homo Sapiens
  primer_bind 1..21: upstream amplification primer 99-13586 for SEQ 216,
cagtagaaagaaaatagaggg

SEQ ID NO: 4151 - DNA, 20 bp, Homo Sapiens
  primer_bind 1..20: upstream amplification primer 99-13588 for SEQ 217,
cgataataggatttggcttc

SEQ ID NO: 4152 - DNA, 21 bp, Homo Sapiens
  primer_bind 1..21: upstream amplification primer 99-13589 for SEQ 218,
aattttcttcagcttgcctcc

SEQ ID NO: 4153 - DNA, 18 bp, Homo Sapiens
  primer_bind 1..18: upstream amplification primer 99-1359 for SEQ 219,
ttccagtccgttattcag

SEQ ID NO: 4154 - DNA, 19 bp, Homo Sapiens
  primer_bind 1..19: upstream amplification primer 99-13591 for SEQ 220,
acatagttgctgtttagag

SEQ ID NO: 4155 - DNA, 18 bp, Homo Sapiens
  primer_bind 1..18: upstream amplification primer 99-13592 for SEQ 221,
gttctacatactcttgcc

SEQ ID NO: 4156 - DNA, 20 bp, Homo Sapiens
  primer_bind 1..20: upstream amplification primer 99-13596 for SEQ 222,
cagtcattgctggggctttc

SEQ ID NO: 4157 - DNA, 19 bp, Homo Sapiens
  primer_bind 1..19: upstream amplification primer 99-13598 for SEQ 223,
agaacagactcagctccag

SEQ ID NO: 4158 - DNA, 20 bp, Homo Sapiens
  primer_bind 1..20: upstream amplification primer 99-13600 for SEQ 224,
cataaagacagcttcattcc

SEQ ID NO: 4159 - DNA, 19 bp, Homo Sapiens
  primer_bind 1..19: upstream amplification primer 99-13601 for SEQ 225,
gttttacttgacagttacc

SEQ ID NO: 4160 - DNA, 19 bp, Homo Sapiens
  primer_bind 1..19: upstream amplification primer 99-13605 for SEQ 226,
tcacttcatactctaatcc

SEQ ID NO: 4161 - DNA, 20 bp, Homo Sapiens
  primer_bind 1..20: upstream amplification primer 99-13606 for SEQ 227,
cttttatcacttgtctgtag

SEQ ID NO: 4162 - DNA, 20 bp, Homo Sapiens
  primer_bind 1..20: upstream amplification primer 99-1362 for SEQ 228,
ggaatatagcaaggtaacag

SEQ ID NO: 4163 - DNA, 18 bp, Homo Sapiens
  primer_bind 1..18: upstream amplification primer 99-13624 for SEQ 229,
tcaactcacagatgcgac

SEQ ID NO: 4164 - DNA, 19 bp, Homo Sapiens
  primer_bind 1..19: upstream amplification primer 99-13638 for SEQ 230,
cccagtgtttgatttgaag

SEQ ID NO: 4165 - DNA, 19 bp, Homo Sapiens
  primer_bind 1..19: upstream amplification primer 99-13644 for SEQ 231,
gtatcttaacgtcctcttc

SEQ ID NO: 4166 - DNA, 18 bp, Homo Sapiens
  primer_bind 1..18: upstream amplification primer 99-13647 for SEQ 232,
tgcttttttcaacgcctc

SEQ ID NO: 4167 - DNA, 21 bp, Homo Sapiens
  primer_bind 1..21: upstream amplification primer 99-13652 for SEQ 233,
ctatacatacattgttctctg

SEQ ID NO: 4168 - DNA, 20 bp, Homo Sapiens
  primer_bind 1..20: upstream amplification primer 99-13663 for SEQ 234,
tccttttccaccctactccc

SEQ ID NO: 4169 - DNA, 18 bp, Homo Sapiens
  primer_bind 1..18: upstream amplification primer 99-13666 for SEQ 235,
tttgggtggagttgttgg

SEQ ID NO: 4170 - DNA, 20 bp, Homo Sapiens
  primer_bind 1..20: upstream amplification primer 99-1367 for SEQ 236,
cttagaaatggttgtggatg

SEQ ID NO: 4171 - DNA, 19 bp, Homo Sapiens
  primer_bind 1..19: upstream amplification primer 99-13671 for SEQ 237,
catgagtaggttcaaatgg

SEQ ID NO: 4172 - DNA, 18 bp, Homo Sapiens
  primer_bind 1..18: upstream amplification primer 99-13678 for SEQ 238,
tggaagtgctcattaagg

SEQ ID NO: 4173 - DNA, 19 bp, Homo Sapiens
  primer_bind 1..19: upstream amplification primer 99-13679 for SEQ 239,
tctcttacttgcattactg

SEQ ID NO: 4174 - DNA, 21 bp, Homo Sapiens
  primer_bind 1..21: upstream amplification primer 99-1368 for SEQ 240,
cagagctattgtttaaaacag

SEQ ID NO: 4175 - DNA, 19 bp, Homo Sapiens
  primer_bind 1..19: upstream amplification primer 99-13684 for SEQ 241,
ttatcactaggtgtcgggg

SEQ ID NO: 4176 - DNA, 18 bp, Homo Sapiens
  primer_bind 1..18: upstream amplification primer 99-13687 for SEQ 242,
ggacgactatgggattac

SEQ ID NO: 4177 - DNA, 19 bp, Homo Sapiens
  primer_bind 1..19: upstream amplification primer 99-1373 for SEQ 243,
atggattgagaaagagaag

SEQ ID NO: 4178 - DNA, 18 bp, Homo Sapiens
  primer_bind 1..18: upstream amplification primer 99-1376 for SEQ 244,
cttcaatgctagaaggac

SEQ ID NO: 4179 - DNA, 20 bp, Homo Sapiens
  primer_bind 1..20: upstream amplification primer 99-13790 for SEQ 245,
gtcattttactaagcctttc

SEQ ID NO: 4180 - DNA, 20 bp, Homo Sapiens
  primer_bind 1..20: upstream amplification primer 99-13798 for SEQ 246,
gaggaaaaggactttggatg

SEQ ID NO: 4181 - DNA, 18 bp, Homo Sapiens
  primer_bind 1..18: upstream amplification primer 99-13831 for SEQ 247,
ggatgaatctggttcttg

SEQ ID NO: 4182 - DNA, 18 bp, Homo Sapiens
  primer_bind 1..18: upstream amplification primer 99-13832 for SEQ 248,
tatctagggaactggagg

SEQ ID NO: 4183 - DNA, 18 bp, Homo Sapiens
  primer_bind 1..18: upstream amplification primer 99-13835 for SEQ 249,
ccagctatgggcaaatac

SEQ ID NO: 4184 - DNA, 19 bp, Homo Sapiens
  primer_bind 1..19: upstream amplification primer 99-1385 for SEQ 250,
acgctggaatttttctttg

SEQ ID NO: 4185 - DNA, 20 bp, Homo Sapiens
  primer_bind 1..20: upstream amplification primer 99-13853 for SEQ 251,
gaccttattaaaaaacccac

SEQ ID NO: 4186 - DNA, 19 bp, Homo Sapiens
  primer_bind 1..19: upstream amplification primer 99-13854 for SEQ 252,
tttggacacattttggcac

SEQ ID NO: 4187 - DNA, 19 bp, Homo Sapiens
  primer_bind 1..19: upstream amplification primer 99-13860 for SEQ 253,
tccaaacattattgagcag

SEQ ID NO: 4188 - DNA, 20 bp, Homo Sapiens
  primer_bind 1..20: upstream amplification primer 99-13861 for SEQ 254,
gtctttgagttttttacacc

SEQ ID NO: 4189 - DNA, 18 bp, Homo Sapiens
  primer_bind 1..18: upstream amplification primer 99-13866 for SEQ 255,
agcaaaagtgactagccc

SEQ ID NO: 4190 - DNA, 18 bp, Homo Sapiens
  primer_bind 1..18: upstream amplification primer 99-13868 for SEQ 256,
gaaagaggatgaagaggg

SEQ ID NO: 4191 - DNA, 21 bp, Homo Sapiens
  primer_bind 1..21: upstream amplification primer 99-1387 for SEQ 257,
ctctcattttttttctctcac

SEQ ID NO: 4192 - DNA, 18 bp, Homo Sapiens
  primer_bind 1..18: upstream amplification primer 99-13876 for SEQ 258,
atgttggtgccttttcag

SEQ ID NO: 4193 - DNA, 18 bp, Homo Sapiens
  primer_bind 1..18: upstream amplification primer 99-13878 for SEQ 259,
gagtgggattaggagaag

SEQ ID NO: 4194 - DNA, 18 bp, Homo Sapiens
  primer_bind 1..18: upstream amplification primer 99-1388 for SEQ 260,
gttctctaagtggtggtc

SEQ ID NO: 4195 - DNA, 20 bp, Homo Sapiens
  primer_bind 1..20: upstream amplification primer 99-13880 for SEQ 261,
caatcaaagatgggcatcag

SEQ ID NO: 4196 - DNA, 18 bp, Homo Sapiens
  primer_bind 1..18: upstream amplification primer 99-13883 for SEQ 262,
ccttccacataaccctac

SEQ ID NO: 4197 - DNA, 21 bp, Homo Sapiens
  primer_bind 1..21: upstream amplification primer 99-13887 for SEQ 263,
cttccttaaatcttctcatac

SEQ ID NO: 4198 - DNA, 18 bp, Homo Sapiens
  primer_bind 1..18: upstream amplification primer 99-13888 for SEQ 264,
aatctcacggtggtgttc

SEQ ID NO: 4199 - DNA, 19 bp, Homo Sapiens
  primer_bind 1..19: upstream amplification primer 99-13892 for SEQ 265,
gtttgagaaatgtgaagag

SEQ ID NO: 4200 - DNA, 18 bp, Homo Sapiens
  primer_bind 1..18: upstream amplification primer 99-13897 for SEQ 266,
ttcccccactttctaacc

SEQ ID NO: 4201 - DNA, 19 bp, Homo Sapiens
  primer_bind 1..19: upstream amplification primer 99-1391 for SEQ 267,
cacagtcatccatttttac

SEQ ID NO: 4202 - DNA, 18 bp, Homo Sapiens
  primer_bind 1..18: upstream amplification primer 99-13912 for SEQ 268,
atgtgaggaatgtctggg

SEQ ID NO: 4203 - DNA, 20 bp, Homo Sapiens
  primer_bind 1..20: upstream amplification primer 99-13913 for SEQ 269,
gttgcctacattcgtaatac

SEQ ID NO: 4204 - DNA, 18 bp, Homo Sapiens
  primer_bind 1..18: upstream amplification primer 99-13914 for SEQ 270,
tccaccctcaactaatac

SEQ ID NO: 4205 - DNA, 18 bp, Homo Sapiens
  primer_bind 1..18: upstream amplification primer 99-1392 for SEQ 271,
ttcacacagcacttaggg

SEQ ID NO: 4206 - DNA, 18 bp, Homo Sapiens
  primer_bind 1..18: upstream amplification primer 99-13920 for SEQ 272,
tgtctggtggtgataaac

SEQ ID NO: 4207 - DNA, 20 bp, Homo Sapiens
  primer_bind 1..20: upstream amplification primer 99-13925 for SEQ 273,
catggaagtaaaagcatatc

SEQ ID NO: 4208 - DNA, 19 bp, Homo Sapiens
  primer_bind 1..19: upstream amplification primer 99-13929 for SEQ 274,
gggagaatactaataatgg

SEQ ID NO: 4209 - DNA, 21 bp, Homo Sapiens
  primer_bind 1..21: upstream amplification primer 99-13932 for SEQ 275,
caatatgtaaggaatgggcac

SEQ ID NO: 4210 - DNA, 18 bp, Homo Sapiens
  primer_bind 1..18: upstream amplification primer 99-1394 for SEQ 276,
ccatatttctcctttccc

SEQ ID NO: 4211 - DNA, 19 bp, Homo Sapiens
  primer_bind 1..19: upstream amplification primer 99-13956 for SEQ 277,
gttttccagtaaaaggcag

SEQ ID NO: 4212 - DNA, 20 bp, Homo Sapiens
  primer_bind 1..20: upstream amplification primer 99-13960 for SEQ 278,
gtggtttgctttaagagtcc

SEQ ID NO: 4213 - DNA, 19 bp, Homo Sapiens
  primer_bind 1..19: upstream amplification primer 99-13962 for SEQ 279,
ttattgactgaggttgttg

SEQ ID NO: 4214 - DNA, 18 bp, Homo Sapiens
  primer_bind 1..18: upstream amplification primer 99-13980 for SEQ 280,
cttaaccccgtgaaactc

SEQ ID NO: 4215 - DNA, 19 bp, Homo Sapiens
  primer_bind 1..19: upstream amplification primer 99-13996 for SEQ 281,
aaaaggattactctgctac

SEQ ID NO: 4216 - DNA, 20 bp, Homo Sapiens
  primer_bind 1..20: upstream amplification primer 99-13997 for SEQ 282,
cgacttgctcagaatcacac

SEQ ID NO: 4217 - DNA, 19 bp, Homo Sapiens
  primer_bind 1..19: upstream amplification primer 99-13998 for SEQ 283,
aatttccttgataggtgag

SEQ ID NO: 4218 - DNA, 19 bp, Homo Sapiens
  primer_bind 1..19: upstream amplification primer 99-140 for SEQ 284,
agagcatagtataaagcag

SEQ ID NO: 4219 - DNA, 20 bp, Homo Sapiens
  primer_bind 1..20: upstream amplification primer 99-14004 for SEQ 285,
aagtggtgatggaggaaggg

SEQ ID NO: 4220 - DNA, 21 bp, Homo Sapiens
  primer_bind 1..21: upstream amplification primer 99-14005 for SEQ 286,
ggcaacttgcaggttttattc

SEQ ID NO: 4221 - DNA, 18 bp, Homo Sapiens
  primer_bind 1..18: upstream amplification primer 99-14009 for SEQ 287,
agttgttatcgactcccc

SEQ ID NO: 4222 - DNA, 19 bp, Homo Sapiens
  primer_bind 1..19: upstream amplification primer 99-14010 for SEQ 288,
actgctatttccctcgctc

SEQ ID NO: 4223 - DNA, 18 bp, Homo Sapiens
  primer_bind 1..18: upstream amplification primer 99-14013 for SEQ 289,
atctggtatcccttgatg

SEQ ID NO: 4224 - DNA, 20 bp, Homo Sapiens
  primer_bind 1..20: upstream amplification primer 99-14025 for SEQ 290,
gacactaaaaggcaattaag

SEQ ID NO: 4225 - DNA, 19 bp, Homo Sapiens
  primer_bind 1..19: upstream amplification primer 99-1404 for SEQ 291,
cttttttctctttttcccc

SEQ ID NO: 4226 - DNA, 19 bp, Homo Sapiens
  primer_bind 1..19: upstream amplification primer 99-14046 for SEQ 292,
ctttgtcttgtctgttctg

SEQ ID NO: 4227 - DNA, 19 bp, Homo Sapiens
  primer_bind 1..19: upstream amplification primer 99-14050 for SEQ 293,
tgggctgctttaagtaatg

SEQ ID NO: 4228 - DNA, 20 bp, Homo Sapiens
  primer_bind 1..20: upstream amplification primer 99-14068 for SEQ 294,
gaatttagtccctagttatg

SEQ ID NO: 4229 - DNA, 19 bp, Homo Sapiens
  primer_bind 1..19: upstream amplification primer 99-14072 for SEQ 295,
tttcttttctaaccctgac

SEQ ID NO: 4230 - DNA, 19 bp, Homo Sapiens
  primer_bind 1..19: upstream amplification primer 99-14080 for SEQ 296,
acttagaaagatagacacc

SEQ ID NO: 4231 - DNA, 19 bp, Homo Sapiens
  primer_bind 1..19: upstream amplification primer 99-14083 for SEQ 297,
tcccttcttttacttacac

SEQ ID NO: 4232 - DNA, 19 bp, Homo Sapiens
  primer_bind 1..19: upstream amplification primer 99-14087 for SEQ 298,
atgctctgcctttcttgcc

SEQ ID NO: 4233 - DNA, 18 bp, Homo Sapiens
  primer_bind 1..18: upstream amplification primer 99-14090 for SEQ 299,
tgaagaggatgaagctgg

SEQ ID NO: 4234 - DNA, 19 bp, Homo Sapiens
  primer_bind 1..19: upstream amplification primer 99-14094 for SEQ 300,
ccttaaagcgaaaaatacc

SEQ ID NO: 4235 - DNA, 19 bp, Homo Sapiens
  primer_bind 1..19: upstream amplification primer 99-14119 for SEQ 301,
agaagtgtgggggttgtag

SEQ ID NO: 4236 - DNA, 18 bp, Homo Sapiens
  primer_bind 1..18: upstream amplification primer 99-14120 for SEQ 302,
gttgtagaaagctccctg

SEQ ID NO: 4237 - DNA, 19 bp, Homo Sapiens
  primer_bind 1..19: upstream amplification primer 99-14127 for SEQ 303,
ttcctatatgaacaccgag

SEQ ID NO: 4238 - DNA, 18 bp, Homo Sapiens
  primer_bind 1..18: upstream amplification primer 99-1413 for SEQ 304,
tctaacggtgtagtagtc

SEQ ID NO: 4239 - DNA, 18 bp, Homo Sapiens
  primer_bind 1..18: upstream amplification primer 99-14135 for SEQ 305,
tttcctactgagctgacc

SEQ ID NO: 4240 - DNA, 19 bp, Homo Sapiens
  primer_bind 1..19: upstream amplification primer 99-14139 for SEQ 306,
gagagattcatgtctttcc

SEQ ID NO: 4241 - DNA, 18 bp, Homo Sapiens
  primer_bind 1..18: upstream amplification primer 99-14140 for SEQ 307,
agttcacagtgtttggag

SEQ ID NO: 4242 - DNA, 18 bp, Homo Sapiens
  primer_bind 1..18: upstream amplification primer 99-14145 for SEQ 308,
attaggaggaaaggggac

SEQ ID NO: 4243 - DNA, 18 bp, Homo Sapiens
  primer_bind 1..18: upstream amplification primer 99-14147 for SEQ 309,
tcaatcaactccccactc

SEQ ID NO: 4244 - DNA, 19 bp, Homo Sapiens
  primer_bind 1..19: upstream amplification primer 99-14149 for SEQ 310,
aactgttgggtatcttttg

SEQ ID NO: 4245 - DNA, 18 bp, Homo Sapiens
  primer_bind 1..18: upstream amplification primer 99-1416 for SEQ 311,
gatagaaaagttcccacc

SEQ ID NO: 4246 - DNA, 18 bp, Homo Sapiens
  primer_bind 1..18: upstream amplification primer 99-14161 for SEQ 312,
tctcttcccctccatatc

SEQ ID NO: 4247 - DNA, 18 bp, Homo Sapiens
  primer_bind 1..18: upstream amplification primer 99-14162 for SEQ 313,
ctgggctaatcatttagg

SEQ ID NO: 4248 - DNA, 18 bp, Homo Sapiens
  primer_bind 1..18: upstream amplification primer 99-14166 for SEQ 314,
tctatgtagacagtcacc

SEQ ID NO: 4249 - DNA, 21 bp, Homo Sapiens
  primer_bind 1..21: upstream amplification primer 99-14175 for SEQ 315,
gatccctttaattctttgaac

SEQ ID NO: 4250 - DNA, 20 bp, Homo Sapiens
  primer_bind 1..20: upstream amplification primer 99-14179 for SEQ 316,
tgcagcacggcagaaaaagc

SEQ ID NO: 4251 - DNA, 18 bp, Homo Sapiens
  primer_bind 1..18: upstream amplification primer 99-14186 for SEQ 317,
taatacggttgttccctg

SEQ ID NO: 4252 - DNA, 18 bp, Homo Sapiens
  primer_bind 1..18: upstream amplification primer 99-14197 for SEQ 318,
ccctttctgtaagtctac

SEQ ID NO: 4253 - DNA, 20 bp, Homo Sapiens
  primer_bind 1..20: upstream amplification primer 99-14203 for SEQ 319,
acatagcctgtcccttggag

SEQ ID NO: 4254 - DNA, 20 bp, Homo Sapiens
  primer_bind 1..20: upstream amplification primer 99-14204 for SEQ 320,
tgtgtgactgagttcccacc

SEQ ID NO: 4255 - DNA, 18 bp, Homo Sapiens
  primer_bind 1..18: upstream amplification primer 99-14220 for SEQ 321,
taactccagactctccac

SEQ ID NO: 4256 - DNA, 18 bp, Homo Sapiens
  primer_bind 1..18: upstream amplification primer 99-1423 for SEQ 322,
ttgaagccttgattgggg

SEQ ID NO: 4257 - DNA, 19 bp, Homo Sapiens
  primer_bind 1..19: upstream amplification primer 99-14250 for SEQ 323,
aatacttctctcaacttcc

SEQ ID NO: 4258 - DNA, 19 bp, Homo Sapiens
  primer_bind 1..19: upstream amplification primer 99-14254 for SEQ 324,
tacaactacttaaacaggg

SEQ ID NO: 4259 - DNA, 18 bp, Homo Sapiens
  primer_bind 1..18: upstream amplification primer 99-14256 for SEQ 325,
acctttgtttagcactgg

SEQ ID NO: 4260 - DNA, 20 bp, Homo Sapiens
  primer_bind 1..20: upstream amplification primer 99-1426 for SEQ 326,
cagagatttagagggaatac

SEQ ID NO: 4261 - DNA, 19 bp, Homo Sapiens
  primer_bind 1..19: upstream amplification primer 99-14260 for SEQ 327,
agagaagcaacattactac

SEQ ID NO: 4262 - DNA, 21 bp, Homo Sapiens
  primer_bind 1..21: upstream amplification primer 99-14277 for SEQ 328,
gggaagctgagaaggaaagtg

SEQ ID NO: 4263 - DNA, 20 bp, Homo Sapiens
  primer_bind 1..20: upstream amplification primer 99-14282 for SEQ 329,
ctgtttgttcctcttgtttg

SEQ ID NO: 4264 - DNA, 21 bp, Homo Sapiens
  primer_bind 1..21: upstream amplification primer 99-14285 for SEQ 330,
cacttcccaagtccaaataac

SEQ ID NO: 4265 - DNA, 20 bp, Homo Sapiens
  primer_bind 1..20: upstream amplification primer 99-14286 for SEQ 331,
gcaagaagctgaatcaacgg

SEQ ID NO: 4266 - DNA, 21 bp, Homo Sapiens
  primer_bind 1..21: upstream amplification primer 99-14309 for SEQ 332,
gctggtagacttgtactgatg

SEQ ID NO: 4267 - DNA, 21 bp, Homo Sapiens
  primer_bind 1..21: upstream amplification primer 99-14315 for SEQ 333,
gtcaagttgtataaacaatcc

SEQ ID NO: 4268 - DNA, 20 bp, Homo Sapiens
  primer_bind 1..20: upstream amplification primer 99-14329 for SEQ 334,
ggcatcattatgcacaaatc

SEQ ID NO: 4269 - DNA, 21 bp, Homo Sapiens
  primer_bind 1..21: upstream amplification primer 99-14331 for SEQ 335,
agcccaccatcagaaaatcag

SEQ ID NO: 4270 - DNA, 19 bp, Homo Sapiens
  primer_bind 1..19: upstream amplification primer 99-14332 for SEQ 336,
gttattaaggcgttgtcag

SEQ ID NO: 4271 - DNA, 21 bp, Homo Sapiens
  primer_bind 1..21: upstream amplification primer 99-14343 for SEQ 337,
ggaaatgatgattgaactatg

SEQ ID NO: 4272 - DNA, 19 bp, Homo Sapiens
  primer_bind 1..19: upstream amplification primer 99-14345 for SEQ 338,
gctgctttcctacatcatc

SEQ ID NO: 4273 - DNA, 19 bp, Homo Sapiens
  primer_bind 1..19: upstream amplification primer 99-14356 for SEQ 339,
tgattgatgaaaagtggac

SEQ ID NO: 4274 - DNA, 20 bp, Homo Sapiens
  primer_bind 1..20: upstream amplification primer 99-1437 for SEQ 340,
caaaagaaactcacaaagac

SEQ ID NO: 4275 - DNA, 21 bp, Homo Sapiens
  primer_bind 1..21: upstream amplification primer 99-14385 for SEQ 341,
gttatgtctcttgccttcttg

SEQ ID NO: 4276 - DNA, 18 bp, Homo Sapiens
  primer_bind 1..18: upstream amplification primer 99-14392 for SEQ 342,
gccttcaactaagctctg

SEQ ID NO: 4277 - DNA, 19 bp, Homo Sapiens
  primer_bind 1..19: upstream amplification primer 99-14393 for SEQ 343,
tgtgtgtaatgattgtgag

SEQ ID NO: 4278 - DNA, 18 bp, Homo Sapiens
  primer_bind 1..18: upstream amplification primer 99-144 for SEQ 344,
cttgccatgtaatgatgc

SEQ ID NO: 4279 - DNA, 18 bp, Homo Sapiens
  primer_bind 1..18: upstream amplification primer 99-14405 for SEQ 345,
gtctaatgtgcaaggctc

SEQ ID NO: 4280 - DNA, 18 bp, Homo Sapiens
  primer_bind 1..18: upstream amplification primer 99-1442 for SEQ 346,
tctggtatttgggaacac

SEQ ID NO: 4281 - DNA, 21 bp, Homo Sapiens
  primer_bind 1..21: upstream amplification primer 99-14444 for SEQ 347,
gtatcatcaacctaacttatc

SEQ ID NO: 4282 - DNA, 18 bp, Homo Sapiens
  primer_bind 1..18: upstream amplification primer 99-14446 for SEQ 348,
ggtttttgtttagggagg

SEQ ID NO: 4283 - DNA, 19 bp, Homo Sapiens
  primer_bind 1..19: upstream amplification primer 99-14452 for SEQ 349,
ctttggctcctatacatac

SEQ ID NO: 4284 - DNA, 19 bp, Homo Sapiens
  primer_bind 1..19: upstream amplification primer 99-14459 for SEQ 350,
catggacatgagttatcag

SEQ ID NO: 4285 - DNA, 18 bp, Homo Sapiens
  primer_bind 1..18: upstream amplification primer 99-14468 for SEQ 351,
ctctccttgccttgggtc

SEQ ID NO: 4286 - DNA, 19 bp, Homo Sapiens
  primer_bind 1..19: upstream amplification primer 99-14470 for SEQ 352,
ttgtctcttgttcttgatg

SEQ ID NO: 4287 - DNA, 19 bp, Homo Sapiens
  primer_bind 1..19: upstream amplification primer 99-14492 for SEQ 353,
tgcatggtcttgtattaac

SEQ ID NO: 4288 - DNA, 18 bp, Homo Sapiens
  primer_bind 1..18: upstream amplification primer 99-14497 for SEQ 354,
ccaggaacatcaactcag

SEQ ID NO: 4289 - DNA, 18 bp, Homo Sapiens
  primer_bind 1..18: upstream amplification primer 99-14505 for SEQ 355,
ggttgctgtctttccttc

SEQ ID NO: 4290 - DNA, 20 bp, Homo Sapiens
  primer_bind 1..20: upstream amplification primer 99-14518 for SEQ 356,
agtggctcaggtaaaggcag

SEQ ID NO: 4291 - DNA, 20 bp, Homo Sapiens
  primer_bind 1..20: upstream amplification primer 99-1453 for SEQ 357,
gtaggtatatggaaagtgtg

SEQ ID NO: 4292 - DNA, 18 bp, Homo Sapiens
  primer_bind 1..18: upstream amplification primer 99-14553 for SEQ 358,
gattgcctcatatcctac

SEQ ID NO: 4293 - DNA, 19 bp, Homo Sapiens
  primer_bind 1..19: upstream amplification primer 99-14562 for SEQ 359,
atagttagggtgggtctgg

SEQ ID NO: 4294 - DNA, 19 bp, Homo Sapiens
  primer_bind 1..19: upstream amplification primer 99-14566 for SEQ 360,
cctacttttctgaatggtg

SEQ ID NO: 4295 - DNA, 19 bp, Homo Sapiens
  primer_bind 1..19: upstream amplification primer 99-14574 for SEQ 361,
caaaaatcctcttctccac

SEQ ID NO: 4296 - DNA, 21 bp, Homo Sapiens
  primer_bind 1..21: upstream amplification primer 99-14581 for SEQ 362,
tgccagttttcaagtttgaag

SEQ ID NO: 4297 - DNA, 18 bp, Homo Sapiens
  primer_bind 1..18: upstream amplification primer 99-14591 for SEQ 363,
gaggttggtaagtaacgg

SEQ ID NO: 4298 - DNA, 19 bp, Homo Sapiens
  primer_bind 1..19: upstream amplification primer 99-14595 for SEQ 364,
aatatacttgattccagcc

SEQ ID NO: 4299 - DNA, 21 bp, Homo Sapiens
  primer_bind 1..21: upstream amplification primer 99-14596 for SEQ 365,
gtgttatatgacaagttgaag

SEQ ID NO: 4300 - DNA, 19 bp, Homo Sapiens
  primer_bind 1..19: upstream amplification primer 99-14597 for SEQ 366,
gttttttgctggcttttgg

SEQ ID NO: 4301 - DNA, 20 bp, Homo Sapiens
  primer_bind 1..20: upstream amplification primer 99-14598 for SEQ 367,
ccagttcacaaattcaagtc

SEQ ID NO: 4302 - DNA, 20 bp, Homo Sapiens
  primer_bind 1..20: upstream amplification primer 99-14599 for SEQ 368,
cagtatgccaaatgtctttc

SEQ ID NO: 4303 - DNA, 19 bp, Homo Sapiens
  primer_bind 1..19: upstream amplification primer 99-14600 for SEQ 369,
agaaacgccaatataactg

SEQ ID NO: 4304 - DNA, 21 bp, Homo Sapiens
  primer_bind 1..21: upstream amplification primer 99-14601 for SEQ 370,
gatgtattgaaagaaactgag

SEQ ID NO: 4305 - DNA, 20 bp, Homo Sapiens
  primer_bind 1..20: upstream amplification primer 99-14607 for SEQ 371,
agcatagcagtgagcaggag

SEQ ID NO: 4306 - DNA, 19 bp, Homo Sapiens
  primer_bind 1..19: upstream amplification primer 99-14609 for SEQ 372,
gttatatctacctatcgtc

SEQ ID NO: 4307 - DNA, 19 bp, Homo Sapiens
  primer_bind 1..19: upstream amplification primer 99-14610 for SEQ 373,
attttccgaatacaaggag

SEQ ID NO: 4308 - DNA, 21 bp, Homo Sapiens
  primer_bind 1..21: upstream amplification primer 99-14611 for SEQ 374,
cttctagttatctttctctac

SEQ ID NO: 4309 - DNA, 21 bp, Homo Sapiens
  primer_bind 1..21: upstream amplification primer 99-14612 for SEQ 375,
acattacataagctatttgcc

SEQ ID NO: 4310 - DNA, 21 bp, Homo Sapiens
  primer_bind 1..21: upstream amplification primer 99-14614 for SEQ 376,
ggaaaactcttcgtatttatc

SEQ ID NO: 4311 - DNA, 20 bp, Homo Sapiens
  primer_bind 1..20: upstream amplification primer 99-14615 for SEQ 377,
taatgagcacattatatccc

SEQ ID NO: 4312 - DNA, 19 bp, Homo Sapiens
  primer_bind 1..19: upstream amplification primer 99-14616 for SEQ 378,
aagcctgctcaatgcctac

SEQ ID NO: 4313 - DNA, 18 bp, Homo Sapiens
  primer_bind 1..18: upstream amplification primer 99-14618 for SEQ 379,
aacgtcgtgacttgaacc

SEQ ID NO: 4314 - DNA, 19 bp, Homo Sapiens
  primer_bind 1..19: upstream amplification primer 99-14619 for SEQ 380,
atctcaacacatgaaagac

SEQ ID NO: 4315 - DNA, 19 bp, Homo Sapiens
  primer_bind 1..19: upstream amplification primer 99-1462 for SEQ 381,
ctagaagtagctttaacag

SEQ ID NO: 4316 - DNA, 19 bp, Homo Sapiens
  primer_bind 1..19: upstream amplification primer 99-14620 for SEQ 382,
ataaggaacattcacacac

SEQ ID NO: 4317 - DNA, 18 bp, Homo Sapiens
  primer_bind 1..18: upstream amplification primer 99-14621 for SEQ 383,
aaaacccttgatccctac

SEQ ID NO: 4318 - DNA, 21 bp, Homo Sapiens
  primer_bind 1..21: upstream amplification primer 99-14622 for SEQ 384,
tttttgtcttaacatctgctc

SEQ ID NO: 4319 - DNA, 21 bp, Homo Sapiens
  primer_bind 1..21: upstream amplification primer 99-14626 for SEQ 385,
ggataaagacatttagcaaac

SEQ ID NO: 4320 - DNA, 20 bp, Homo Sapiens
  primer_bind 1..20: upstream amplification primer 99-14627 for SEQ 386,
ccttgatactatttgatacc

SEQ ID NO: 4321 - DNA, 19 bp, Homo Sapiens
  primer_bind 1..19: upstream amplification primer 99-14628 for SEQ 387,
ttcagagaattatcatgcc

SEQ ID NO: 4322 - DNA, 21 bp, Homo Sapiens
  primer_bind 1..21: upstream amplification primer 99-14629 for SEQ 388,
ttatttccctgtagtgaagcc

SEQ ID NO: 4323 - DNA, 20 bp, Homo Sapiens
  primer_bind 1..20: upstream amplification primer 99-14630 for SEQ 389,
cacaagaccaaaagcatcag

SEQ ID NO: 4324 - DNA, 18 bp, Homo Sapiens
  primer_bind 1..18: upstream amplification primer 99-14634 for SEQ 390,
cacgaggctagttgatac

SEQ ID NO: 4325 - DNA, 18 bp, Homo Sapiens
  primer_bind 1..18: upstream amplification primer 99-14635 for SEQ 391,
atgcgttttcccgataag

SEQ ID NO: 4326 - DNA, 19 bp, Homo Sapiens
  primer_bind 1..19: upstream amplification primer 99-14637 for SEQ 392,
agtgtaattggaaaaggtg

SEQ ID NO: 4327 - DNA, 19 bp, Homo Sapiens
  primer_bind 1..19: upstream amplification primer 99-14638 for SEQ 393,
catccagagagagtgaatc

SEQ ID NO: 4328 - DNA, 20 bp, Homo Sapiens
  primer_bind 1..20: upstream amplification primer 99-14643 for SEQ 394,
gcagcaattttaagccatag

SEQ ID NO: 4329 - DNA, 19 bp, Homo Sapiens
  primer_bind 1..19: upstream amplification primer 99-14644 for SEQ 395,
aaagctatctctattgctg

SEQ ID NO: 4330 - DNA, 19 bp, Homo Sapiens
  primer_bind 1..19: upstream amplification primer 99-14647 for SEQ 396,
gaacctaaaccaatcaacg

SEQ ID NO: 4331 - DNA, 21 bp, Homo Sapiens
  primer_bind 1..21: upstream amplification primer 99-14651 for SEQ 397,
cagttacttcttcattatctc

SEQ ID NO: 4332 - DNA, 20 bp, Homo Sapiens
  primer_bind 1..20: upstream amplification primer 99-14652 for SEQ 398,
aagattgttcccctaagttg

SEQ ID NO: 4333 - DNA, 18 bp, Homo Sapiens
  primer_bind 1..18: upstream amplification primer 99-14653 for SEQ 399,
tagtttgagatggggtgg

SEQ ID NO: 4334 - DNA, 19 bp, Homo Sapiens
  primer_bind 1..19: upstream amplification primer 99-14662 for SEQ 400,
gagaaacatagatttgagg

SEQ ID NO: 4335 - DNA, 20 bp, Homo Sapiens
  primer_bind 1..20: upstream amplification primer 99-14664 for SEQ 401,
cctctattcatccctttgac

SEQ ID NO: 4336 - DNA, 19 bp, Homo Sapiens
  primer_bind 1..19: upstream amplification primer 99-14665 for SEQ 402,
tatgttggttgaagcggcg

SEQ ID NO: 4337 - DNA, 21 bp, Homo Sapiens
  primer_bind 1..21: upstream amplification primer 99-14669 for SEQ 403,
gtattttgaggaagagagaag

SEQ ID NO: 4338 - DNA, 21 bp, Homo Sapiens
  primer_bind 1..21: upstream amplification primer 99-14671 for SEQ 404,
caataccttacaatttcaacc

SEQ ID NO: 4339 - DNA, 18 bp, Homo Sapiens
  primer_bind 1..18: upstream amplification primer 99-14676 for SEQ 405,
aatatccagtgacgagcc

SEQ ID NO: 4340 - DNA, 20 bp, Homo Sapiens
  primer_bind 1..20: upstream amplification primer 99-14677 for SEQ 406,
aatctattcaccaaggtatc

SEQ ID NO: 4341 - DNA, 20 bp, Homo Sapiens
  primer_bind 1..20: upstream amplification primer 99-14678 for SEQ 407,
gcaaaacatccgattatgtg

SEQ ID NO: 4342 - DNA, 21 bp, Homo Sapiens
  primer_bind 1..21: upstream amplification primer 99-14679 for SEQ 408,
caaacaccaccaatactttcc

SEQ ID NO: 4343 - DNA, 18 bp, Homo Sapiens
  primer_bind 1..18: upstream amplification primer 99-1468 for SEQ 409,
cttctttactgtctgtcc

SEQ ID NO: 4344 - DNA, 19 bp, Homo Sapiens
  primer_bind 1..19: upstream amplification primer 99-1469 for SEQ 410,
atactgaatttccctgatg

SEQ ID NO: 4345 - DNA, 21 bp, Homo Sapiens
  primer_bind 1..21: upstream amplification primer 99-14690 for SEQ 411,
gttatctatcagtagctgagg

SEQ ID NO: 4346 - DNA, 18 bp, Homo Sapiens
  primer_bind 1..18: upstream amplification primer 99-14692 for SEQ 412,
agactcgtattgctgacc

SEQ ID NO: 4347 - DNA, 21 bp, Homo Sapiens
  primer_bind 1..21: upstream amplification primer 99-14699 for SEQ 413,
gatattacgggtgttagattg

SEQ ID NO: 4348 - DNA, 19 bp, Homo Sapiens
  primer_bind 1..19: upstream amplification primer 99-147 for SEQ 414,
gcagccaatcttatatttc

SEQ ID NO: 4349 - DNA, 20 bp, Homo Sapiens
  primer_bind 1..20: upstream amplification primer 99-14701 for SEQ 415,
tgggtggatatggagaggtg

SEQ ID NO: 4350 - DNA, 20 bp, Homo Sapiens
  primer_bind 1..20: upstream amplification primer 99-14704 for SEQ 416,
gcatttttcttcgtaacatc

SEQ ID NO: 4351 - DNA, 21 bp, Homo Sapiens
  primer_bind 1..21: upstream amplification primer 99-14708 for SEQ 417,
ggacaggagaaagagatgagg

SEQ ID NO: 4352 - DNA, 19 bp, Homo Sapiens
  primer_bind 1..19: upstream amplification primer 99-1471 for SEQ 418,
tgatgtctatgttagtagc

SEQ ID NO: 4353 - DNA, 20 bp, Homo Sapiens
  primer_bind 1..20: upstream amplification primer 99-14710 for SEQ 419,
ggattgtttagaaaagacgc

SEQ ID NO: 4354 - DNA, 21 bp, Homo Sapiens
  primer_bind 1..21: upstream amplification primer 99-14712 for SEQ 420,
ttcctgaaagtggtatgtctc

SEQ ID NO: 4355 - DNA, 19 bp, Homo Sapiens
  primer_bind 1..19: upstream amplification primer 99-14714 for SEQ 421,
cttttgttctagtagcatc

SEQ ID NO: 4356 - DNA, 20 bp, Homo Sapiens
  primer_bind 1..20: upstream amplification primer 99-14717 for SEQ 422,
ggaaagaaggatggttttag

SEQ ID NO: 4357 - DNA, 18 bp, Homo Sapiens
  primer_bind 1..18: upstream amplification primer 99-1472 for SEQ 423,
gggtacacattgaatgac

SEQ ID NO: 4358 - DNA, 19 bp, Homo Sapiens
  primer_bind 1..19: upstream amplification primer 99-14722 for SEQ 424,
attcatttgggtgttgtgg

SEQ ID NO: 4359 - DNA, 19 bp, Homo Sapiens
  primer_bind 1..19: upstream amplification primer 99-14729 for SEQ 425,
cacaagcataagaattagg

SEQ ID NO: 4360 - DNA, 19 bp, Homo Sapiens
  primer_bind 1..19: upstream amplification primer 99-14733 for SEQ 426,
ctcaccacttaaactgaac

SEQ ID NO: 4361 - DNA, 19 bp, Homo Sapiens
  primer_bind 1..19: upstream amplification primer 99-14735 for SEQ 427,
ataagaactggatcattgg

SEQ ID NO: 4362 - DNA, 19 bp, Homo Sapiens
  primer_bind 1..19: upstream amplification primer 99-1474 for SEQ 428,
aaggttgtagagtagaaag

SEQ ID NO: 4363 - DNA, 20 bp, Homo Sapiens
  primer_bind 1..20: upstream amplification primer 99-14746 for SEQ 429,
atgacagggtctggaatttg

SEQ ID NO: 4364 - DNA, 18 bp, Homo Sapiens
  primer_bind 1..18: upstream amplification primer 99-14753 for SEQ 430,
gggctaaaattactcgtc

SEQ ID NO: 4365 - DNA, 19 bp, Homo Sapiens
  primer_bind 1..19: upstream amplification primer 99-14756 for SEQ 431,
ggctactacattcttagac

SEQ ID NO: 4366 - DNA, 19 bp, Homo Sapiens
  primer_bind 1..19: upstream amplification primer 99-1476 for SEQ 432,
tgtgtgtgttttggggagg

SEQ ID NO: 4367 - DNA, 21 bp, Homo Sapiens
  primer_bind 1..21: upstream amplification primer 99-14761 for SEQ 433,
ggtgtagttaggatgtgtttg

SEQ ID NO: 4368 - DNA, 19 bp, Homo Sapiens
  primer_bind 1..19: upstream amplification primer 99-14773 for SEQ 434,
caggttcgtttctcttttc

SEQ ID NO: 4369 - DNA, 19 bp, Homo Sapiens
  primer_bind 1..19: upstream amplification primer 99-14776 for SEQ 435,
gtacttcaaattaccaccg

SEQ ID NO: 4370 - DNA, 20 bp, Homo Sapiens
  primer_bind 1..20: upstream amplification primer 99-14777 for SEQ 436,
ctctaaaaacaatcaaaggg

SEQ ID NO: 4371 - DNA, 19 bp, Homo Sapiens
  primer_bind 1..19: upstream amplification primer 99-14782 for SEQ 437,
gatatagacgagaaaggag

SEQ ID NO: 4372 - DNA, 21 bp, Homo Sapiens
  primer_bind 1..21: upstream amplification primer 99-14784 for SEQ 438,
gaaaaaatgatgttagtggtg

SEQ ID NO: 4373 - DNA, 20 bp, Homo Sapiens
  primer_bind 1..20: upstream amplification primer 99-14785 for SEQ 439,
ggtcaaggtcatagagcaag

SEQ ID NO: 4374 - DNA, 19 bp, Homo Sapiens
  primer_bind 1..19: upstream amplification primer 99-14786 for SEQ 440,
gggtaaataagtgtttggg

SEQ ID NO: 4375 - DNA, 18 bp, Homo Sapiens
  primer_bind 1..18: upstream amplification primer 99-1479 for SEQ 441,
caactgacactataaccc

SEQ ID NO: 4376 - DNA, 20 bp, Homo Sapiens
  primer_bind 1..20: upstream amplification primer 99-14792 for SEQ 442,
gggagtgttaaagataaatg

SEQ ID NO: 4377 - DNA, 21 bp, Homo Sapiens
  primer_bind 1..21: upstream amplification primer 99-14796 for SEQ 443,
ggaacatacatagaataaagg

SEQ ID NO: 4378 - DNA, 21 bp, Homo Sapiens
  primer_bind 1..21: upstream amplification primer 99-14799 for SEQ 444,
cagcagaaaaaagcaaatgag

SEQ ID NO: 4379 - DNA, 18 bp, Homo Sapiens
  primer_bind 1..18: upstream amplification primer 99-148 for SEQ 445,
cagtggagtgtttatgtg

SEQ ID NO: 4380 - DNA, 19 bp, Homo Sapiens
  primer_bind 1..19: upstream amplification primer 99-1480 for SEQ 446,
ttgcacaaaaggtatagag

SEQ ID NO: 4381 - DNA, 19 bp, Homo Sapiens
  primer_bind 1..19: upstream amplification primer 99-14802 for SEQ 447,
caaatagccaccatataag

SEQ ID NO: 4382 - DNA, 20 bp, Homo Sapiens
  primer_bind 1..20: upstream amplification primer 99-14803 for SEQ 448,
caagatcattgacattttcc

SEQ ID NO: 4383 - DNA, 21 bp, Homo Sapiens
  primer_bind 1..21: upstream amplification primer 99-14804 for SEQ 449,
gaagaattgtagtgagttaag

SEQ ID NO: 4384 - DNA, 21 bp, Homo Sapiens
  primer_bind 1..21: upstream amplification primer 99-14805 for SEQ 450,
gcatgatgtttatgtgccaag

SEQ ID NO: 4385 - DNA, 20 bp, Homo Sapiens
  primer_bind 1..20: upstream amplification primer 99-14806 for SEQ 451,
ctacttaggagggcattttc

SEQ ID NO: 4386 - DNA, 20 bp, Homo Sapiens
  primer_bind 1..20: upstream amplification primer 99-14807 for SEQ 452,
ctctctctaatttgggatgg

SEQ ID NO: 4387 - DNA, 19 bp, Homo Sapiens
  primer_bind 1..19: upstream amplification primer 99-1481 for SEQ 453,
aggctccccttttgagttg

SEQ ID NO: 4388 - DNA, 19 bp, Homo Sapiens
  primer_bind 1..19: upstream amplification primer 99-14810 for SEQ 454,
gacgctctttatagggaac

SEQ ID NO: 4389 - DNA, 19 bp, Homo Sapiens
  primer_bind 1..19: upstream amplification primer 99-14812 for SEQ 455,
tggcaagaataatagtgtc

SEQ ID NO: 4390 - DNA, 19 bp, Homo Sapiens
  primer_bind 1..19: upstream amplification primer 99-14817 for SEQ 456,
agtcatagataggagaaag

SEQ ID NO: 4391 - DNA, 20 bp, Homo Sapiens
  primer_bind 1..20: upstream amplification primer 99-14818 for SEQ 457,
atgcacctgttccctccttc

SEQ ID NO: 4392 - DNA, 20 bp, Homo Sapiens
  primer_bind 1..20: upstream amplification primer 99-14819 for SEQ 458,
gttggaaagattagcaagag

SEQ ID NO: 4393 - DNA, 21 bp, Homo Sapiens
  primer_bind 1..21: upstream amplification primer 99-14820 for SEQ 459,
cagttttattcctcacactcc

SEQ ID NO: 4394 - DNA, 21 bp, Homo Sapiens
  primer_bind 1..21: upstream amplification primer 99-14821 for SEQ 460,
ctaagtgcggagacgaaaagg

SEQ ID NO: 4395 - DNA, 20 bp, Homo Sapiens
  primer_bind 1..20: upstream amplification primer 99-14826 for SEQ 461,
gccgtgtatctactggagag

SEQ ID NO: 4396 - DNA, 21 bp, Homo Sapiens
  primer_bind 1..21: upstream amplification primer 99-14828 for SEQ 462,
gattttactttatggtatgcc

SEQ ID NO: 4397 - DNA, 18 bp, Homo Sapiens
  primer_bind 1..18: upstream amplification primer 99-14833 for SEQ 463,
attcctcgctgaagtgtg

SEQ ID NO: 4398 - DNA, 18 bp, Homo Sapiens
  primer_bind 1..18: upstream amplification primer 99-1484 for SEQ 464,
atcctttctagctgggag

SEQ ID NO: 4399 - DNA, 19 bp, Homo Sapiens
  primer_bind 1..19: upstream amplification primer 99-14843 for SEQ 465,
gagcaattccagcattcag

SEQ ID NO: 4400 - DNA, 21 bp, Homo Sapiens
  primer_bind 1..21: upstream amplification primer 99-14844 for SEQ 466,
caaattatccatacattggtg

SEQ ID NO: 4401 - DNA, 20 bp, Homo Sapiens
  primer_bind 1..20: upstream amplification primer 99-1485 for SEQ 467,
gtttaagaatgtgtgatggg

SEQ ID NO: 4402 - DNA, 20 bp, Homo Sapiens
  primer_bind 1..20: upstream amplification primer 99-14850 for SEQ 468,
gttttacctcaataccactc

SEQ ID NO: 4403 - DNA, 21 bp, Homo Sapiens
  primer_bind 1..21: upstream amplification primer 99-14856 for SEQ 469,
gagaagttatccaagaaatac

SEQ ID NO: 4404 - DNA, 18 bp, Homo Sapiens
  primer_bind 1..18: upstream amplification primer 99-14861 for SEQ 470,
atatgacatgctgctcac

SEQ ID NO: 4405 - DNA, 21 bp, Homo Sapiens
  primer_bind 1..21: upstream amplification primer 99-14862 for SEQ 471,
catttttatcagcctttaagc

SEQ ID NO: 4406 - DNA, 19 bp, Homo Sapiens
  primer_bind 1..19: upstream amplification primer 99-14865 for SEQ 472,
tgttctgtgggtgaggttg

SEQ ID NO: 4407 - DNA, 19 bp, Homo Sapiens
  primer_bind 1..19: upstream amplification primer 99-14867 for SEQ 473,
atcgggtcctaattatctg

SEQ ID NO: 4408 - DNA, 18 bp, Homo Sapiens
  primer_bind 1..18: upstream amplification primer 99-14872 for SEQ 474,
catttgttctggagcaac

SEQ ID NO: 4409 - DNA, 19 bp, Homo Sapiens
  primer_bind 1..19: upstream amplification primer 99-14873 for SEQ 475,
gtagttgctgattgagtcc

SEQ ID NO: 4410 - DNA, 20 bp, Homo Sapiens
  primer_bind 1..20: upstream amplification primer 99-14875 for SEQ 476,
caatgttttgatgatgtggg

SEQ ID NO: 4411 - DNA, 21 bp, Homo Sapiens
  primer_bind 1..21: upstream amplification primer 99-14879 for SEQ 477,
gcaagttgaatatggcatcag

SEQ ID NO: 4412 - DNA, 19 bp, Homo Sapiens
  primer_bind 1..19: upstream amplification primer 99-14881 for SEQ 478,
atcatgccaagccacatcc

SEQ ID NO: 4413 - DNA, 19 bp, Homo Sapiens
  primer_bind 1..19: upstream amplification primer 99-14882 for SEQ 479,
accaacatccctccattcc

SEQ ID NO: 4414 - DNA, 19 bp, Homo Sapiens
  primer_bind 1..19: upstream amplification primer 99-14883 for SEQ 480,
ttccgctacaagaggtgac

SEQ ID NO: 4415 - DNA, 19 bp, Homo Sapiens
  primer_bind 1..19: upstream amplification primer 99-1489 for SEQ 481,
tcccaaccttgaaagagcc

SEQ ID NO: 4416 - DNA, 20 bp, Homo Sapiens
  primer_bind 1..20: upstream amplification primer 99-14890 for SEQ 482,
cagaaatcatccctttattg

SEQ ID NO: 4417 - DNA, 19 bp, Homo Sapiens
  primer_bind 1..19: upstream amplification primer 99-14892 for SEQ 483,
ggagactaagaatcttatc

SEQ ID NO: 4418 - DNA, 20 bp, Homo Sapiens
  primer_bind 1..20: upstream amplification primer 99-14894 for SEQ 484,
acccactgttgttgctcctc

SEQ ID NO: 4419 - DNA, 18 bp, Homo Sapiens
  primer_bind 1..18: upstream amplification primer 99-14895 for SEQ 485,
tgggtattgaactttggg

SEQ ID NO: 4420 - DNA, 20 bp, Homo Sapiens
  primer_bind 1..20: upstream amplification primer 99-14897 for SEQ 486,
cactgtagctgtttgaaatc

SEQ ID NO: 4421 - DNA, 19 bp, Homo Sapiens
  primer_bind 1..19: upstream amplification primer 99-1490 for SEQ 487,
aaggcaacagcgttgtgac

SEQ ID NO: 4422 - DNA, 19 bp, Homo Sapiens
  primer_bind 1..19: upstream amplification primer 99-14907 for SEQ 488,
gtcaccaaatagtattctg

SEQ ID NO: 4423 - DNA, 18 bp, Homo Sapiens
  primer_bind 1..18: upstream amplification primer 99-1493 for SEQ 489,
ttttgggggttttcagtg

SEQ ID NO: 4424 - DNA, 19 bp, Homo Sapiens
  primer_bind 1..19: upstream amplification primer 99-14937 for SEQ 490,
cctgacttccaaaatcaac

SEQ ID NO: 4425 - DNA, 20 bp, Homo Sapiens
  primer_bind 1..20: upstream amplification primer 99-14939 for SEQ 491,
tgtggtggtagtgacgaagg

SEQ ID NO: 4426 - DNA, 19 bp, Homo Sapiens
  primer_bind 1..19: upstream amplification primer 99-1494 for SEQ 492,
ccactgtttctctgacacc

SEQ ID NO: 4427 - DNA, 20 bp, Homo Sapiens
  primer_bind 1..20: upstream amplification primer 99-14940 for SEQ 493,
agctccaacatctttataag

SEQ ID NO: 4428 - DNA, 18 bp, Homo Sapiens
  primer_bind 1..18: upstream amplification primer 99-14950 for SEQ 494,
gccacttttgctactttg

SEQ ID NO: 4429 - DNA, 19 bp, Homo Sapiens
  primer_bind 1..19: upstream amplification primer 99-14959 for SEQ 495,
gatctgccctcttatcaag

SEQ ID NO: 4430 - DNA, 20 bp, Homo Sapiens
  primer_bind 1..20: upstream amplification primer 99-14961 for SEQ 496,
ccagaagtagaacagataag

SEQ ID NO: 4431 - DNA, 18 bp, Homo Sapiens
  primer_bind 1..18: upstream amplification primer 99-14962 for SEQ 497,
ctctgggtaggcaggttc

SEQ ID NO: 4432 - DNA, 18 bp, Homo Sapiens
  primer_bind 1..18: upstream amplification primer 99-14966 for SEQ 498,
tggttaccagatgtgagg

SEQ ID NO: 4433 - DNA, 18 bp, Homo Sapiens
  primer_bind 1..18: upstream amplification primer 99-14970 for SEQ 499,
tattccattccatcccac

SEQ ID NO: 4434 - DNA, 18 bp, Homo Sapiens
  primer_bind 1..18: upstream amplification primer 99-14978 for SEQ 500,
gctgactcatttaactcc

SEQ ID NO: 4435 - DNA, 19 bp, Homo Sapiens
  primer_bind 1..19: upstream amplification primer 99-1498 for SEQ 501,
ctttcagggttttggagac

SEQ ID NO: 4436 - DNA, 19 bp, Homo Sapiens
  primer_bind 1..19: upstream amplification primer 99-14983 for SEQ 502,
ggtaatttatctggacgac

SEQ ID NO: 4437 - DNA, 18 bp, Homo Sapiens
  primer_bind 1..18: upstream amplification primer 99-14984 for SEQ 503,
aaccttaccagacagaac

SEQ ID NO: 4438 - DNA, 19 bp, Homo Sapiens
  primer_bind 1..19: upstream amplification primer 99-15005 for SEQ 504,
ctaaatgaagactcccttg

SEQ ID NO: 4439 - DNA, 18 bp, Homo Sapiens
  primer_bind 1..18: upstream amplification primer 99-15007 for SEQ 505,
gtcatttggcagaacaag

SEQ ID NO: 4440 - DNA, 18 bp, Homo Sapiens
  primer_bind 1..18: upstream amplification primer 99-1501 for SEQ 506,
ggaatctctcttttggtg

SEQ ID NO: 4441 - DNA, 18 bp, Homo Sapiens
  primer_bind 1..18: upstream amplification primer 99-15016 for SEQ 507,
tgcctctttcaacattcc

SEQ ID NO: 4442 - DNA, 18 bp, Homo Sapiens
  primer_bind 1..18: upstream amplification primer 99-15018 for SEQ 508,
gtgctaagtggtggtttc

SEQ ID NO: 4443 - DNA, 19 bp, Homo Sapiens
  primer_bind 1..19: upstream amplification primer 99-15019 for SEQ 509,
tatctcaggctcggtgaac

SEQ ID NO: 4444 - DNA, 18 bp, Homo Sapiens
  primer_bind 1..18: upstream amplification primer 99-15021 for SEQ 510,
atacgaactcctcctgac

SEQ ID NO: 4445 - DNA, 18 bp, Homo Sapiens
  primer_bind 1..18: upstream amplification primer 99-15030 for SEQ 511,
atcatactgtctgggctc

SEQ ID NO: 4446 - DNA, 19 bp, Homo Sapiens
  primer_bind 1..19: upstream amplification primer 99-15039 for SEQ 512,
gtttaacccaaattcagcc

SEQ ID NO: 4447 - DNA, 19 bp, Homo Sapiens
  primer_bind 1..19: upstream amplification primer 99-1504 for SEQ 513,
tgtagggtgatgatttatg

SEQ ID NO: 4448 - DNA, 18 bp, Homo Sapiens
  primer_bind 1..18: upstream amplification primer 99-15043 for SEQ 514,
ttcttttggggacctatc

SEQ ID NO: 4449 - DNA, 19 bp, Homo Sapiens
  primer_bind 1..19: upstream amplification primer 99-15046 for SEQ 515,
gcaaagattcacagaaaag

SEQ ID NO: 4450 - DNA, 19 bp, Homo Sapiens
  primer_bind 1..19: upstream amplification primer 99-1506 for SEQ 516,
tgtaacctttgtttctctg

SEQ ID NO: 4451 - DNA, 18 bp, Homo Sapiens
  primer_bind 1..18: upstream amplification primer 99-15072 for SEQ 517,
tatagttgcagacttccc

SEQ ID NO: 4452 - DNA, 21 bp, Homo Sapiens
  primer_bind 1..21: upstream amplification primer 99-15087 for SEQ 518,
ctgatttacaaatgtaccaag

SEQ ID NO: 4453 - DNA, 20 bp, Homo Sapiens
  primer_bind 1..20: upstream amplification primer 99-15098 for SEQ 519,
gagactccaagttcacaaac

SEQ ID NO: 4454 - DNA, 18 bp, Homo Sapiens
  primer_bind 1..18: upstream amplification primer 99-151 for SEQ 520,
aacacaacagcaaatccc

SEQ ID NO: 4455 - DNA, 20 bp, Homo Sapiens
  primer_bind 1..20: upstream amplification primer 99-15100 for SEQ 521,
gtttcagggtcacaaatatg

SEQ ID NO: 4456 - DNA, 20 bp, Homo Sapiens
  primer_bind 1..20: upstream amplification primer 99-15101 for SEQ 522,
gatttatagagcatagcagg

SEQ ID NO: 4457 - DNA, 19 bp, Homo Sapiens
  primer_bind 1..19: upstream amplification primer 99-15106 for SEQ 523,
taaggcaggcaacagcatc

SEQ ID NO: 4458 - DNA, 21 bp, Homo Sapiens
  primer_bind 1..21: upstream amplification primer 99-15107 for SEQ 524,
gtctctatcgtaatgacttcc

SEQ ID NO: 4459 - DNA, 21 bp, Homo Sapiens
  primer_bind 1..21: upstream amplification primer 99-15112 for SEQ 525,
ggttactgtagtagattacgg

SEQ ID NO: 4460 - DNA, 20 bp, Homo Sapiens
  primer_bind 1..20: upstream amplification primer 99-15118 for SEQ 526,
ttaggtgctcagcggaagac

SEQ ID NO: 4461 - DNA, 19 bp, Homo Sapiens
  primer_bind 1..19: upstream amplification primer 99-15123 for SEQ 527,
atatccctttcctctttcc

SEQ ID NO: 4462 - DNA, 19 bp, Homo Sapiens
  primer_bind 1..19: upstream amplification primer 99-15128 for SEQ 528,
aaagctgccatcagagtgc

SEQ ID NO: 4463 - DNA, 19 bp, Homo Sapiens
  primer_bind 1..19: upstream amplification primer 99-15129 for SEQ 529,
gggaatgaggtaaaaatgg

SEQ ID NO: 4464 - DNA, 18 bp, Homo Sapiens
  primer_bind 1..18: upstream amplification primer 99-15135 for SEQ 530,
tctcaagatcattgaggg

SEQ ID NO: 4465 - DNA, 19 bp, Homo Sapiens
  primer_bind 1..19: upstream amplification primer 99-15137 for SEQ 531,
agctattgagtctctaatg

SEQ ID NO: 4466 - DNA, 20 bp, Homo Sapiens
  primer_bind 1..20: upstream amplification primer 99-1515 for SEQ 532,
acacaccatgtaggcacgag

SEQ ID NO: 4467 - DNA, 19 bp, Homo Sapiens
  primer_bind 1..19: upstream amplification primer 99-15160 for SEQ 533,
atcccccaccctcaatatc

SEQ ID NO: 4468 - DNA, 19 bp, Homo Sapiens
  primer_bind 1..19: upstream amplification primer 99-15164 for SEQ 534,
gaggtggcataaaattgag

SEQ ID NO: 4469 - DNA, 19 bp, Homo Sapiens
  primer_bind 1..19: upstream amplification primer 99-15193 for SEQ 535,
aacttgattctcatagtgg

SEQ ID NO: 4470 - DNA, 19 bp, Homo Sapiens
  primer_bind 1..19: upstream amplification primer 99-15195 for SEQ 536,
aacttgatttgtgtagacc

SEQ ID NO: 4471 - DNA, 18 bp, Homo Sapiens
  primer_bind 1..18: upstream amplification primer 99-15199 for SEQ 537,
tgggcaaagaaatctagg

SEQ ID NO: 4472 - DNA, 19 bp, Homo Sapiens
  primer_bind 1..19: upstream amplification primer 99-1520 for SEQ 538,
ctgtggaataggtaaaatg

SEQ ID NO: 4473 - DNA, 18 bp, Homo Sapiens
  primer_bind 1..18: upstream amplification primer 99-15200 for SEQ 539,
ttgaaggaggttcagagg

SEQ ID NO: 4474 - DNA, 20 bp, Homo Sapiens
  primer_bind 1..20: upstream amplification primer 99-15202 for SEQ 540,
ctatcagtgcagaatagccc

SEQ ID NO: 4475 - DNA, 19 bp, Homo Sapiens
  primer_bind 1..19: upstream amplification primer 99-1521 for SEQ 541,
tgaagagataaacacacac

SEQ ID NO: 4476 - DNA, 21 bp, Homo Sapiens
  primer_bind 1..21: upstream amplification primer 99-1525 for SEQ 542,
ctttcttacattacatttccc

SEQ ID NO: 4477 - DNA, 18 bp, Homo Sapiens
  primer_bind 1..18: upstream amplification primer 99-15290 for SEQ 543,
tggtaaggtttgatggcg

SEQ ID NO: 4478 - DNA, 20 bp, Homo Sapiens
  primer_bind 1..20: upstream amplification primer 99-15296 for SEQ 544,
gaaataaccccaagttgtag

SEQ ID NO: 4479 - DNA, 20 bp, Homo Sapiens
  primer_bind 1..20: upstream amplification primer 99-15302 for SEQ 545,
cgtctgtcattttcatattg

SEQ ID NO: 4480 - DNA, 19 bp, Homo Sapiens
  primer_bind 1..19: upstream amplification primer 99-15307 for SEQ 546,
ccaaaaaaagtgggtagtg

SEQ ID NO: 4481 - DNA, 19 bp, Homo Sapiens
  primer_bind 1..19: upstream amplification primer 99-15310 for SEQ 547,
ttctgttctctactacttg

SEQ ID NO: 4482 - DNA, 18 bp, Homo Sapiens
  primer_bind 1..18: upstream amplification primer 99-15325 for SEQ 548,
tctgcttcctcacttttc

SEQ ID NO: 4483 - DNA, 18 bp, Homo Sapiens
  primer_bind 1..18: upstream amplification primer 99-15328 for SEQ 549,
ccttctcacctcttttcc

SEQ ID NO: 4484 - DNA, 19 bp, Homo Sapiens
  primer_bind 1..19: upstream amplification primer 99-1533 for SEQ 550,
gtttagcacagttccattg

SEQ ID NO: 4485 - DNA, 18 bp, Homo Sapiens
  primer_bind 1..18: upstream amplification primer 99-15330 for SEQ 551,
cctgcttctcttctttcc

SEQ ID NO: 4486 - DNA, 20 bp, Homo Sapiens
  primer_bind 1..20: upstream amplification primer 99-15335 for SEQ 552,
gaatttcagcctaagaatac

SEQ ID NO: 4487 - DNA, 19 bp, Homo Sapiens
  primer_bind 1..19: upstream amplification primer 99-15339 for SEQ 553,
aatccaaaattgcctacac

SEQ ID NO: 4488 - DNA, 18 bp, Homo Sapiens
  primer_bind 1..18: upstream amplification primer 99-15345 for SEQ 554,
tctcctcctggtttactg

SEQ ID NO: 4489 - DNA, 18 bp, Homo Sapiens
  primer_bind 1..18: upstream amplification primer 99-1535 for SEQ 555,
tttaatccacggaggaac

SEQ ID NO: 4490 - DNA, 21 bp, Homo Sapiens
  primer_bind 1..21: upstream amplification primer 99-1537 for SEQ 556,
ccaaataaaactataacctcc

SEQ ID NO: 4491 - DNA, 18 bp, Homo Sapiens
  primer_bind 1..18: upstream amplification primer 99-15374 for SEQ 557,
taggatcttctgcttctg

SEQ ID NO: 4492 - DNA, 19 bp, Homo Sapiens
  primer_bind 1..19: upstream amplification primer 99-15377 for SEQ 558,
ggtgacatacaatttagag

SEQ ID NO: 4493 - DNA, 21 bp, Homo Sapiens
  primer_bind 1..21: upstream amplification primer 99-15382 for SEQ 559,
ggaatgaaggatgattttaag

SEQ ID NO: 4494 - DNA, 18 bp, Homo Sapiens
  primer_bind 1..18: upstream amplification primer 99-15393 for SEQ 560,
agagaaaaatgggaaggg

SEQ ID NO: 4495 - DNA, 18 bp, Homo Sapiens
  primer_bind 1..18: upstream amplification primer 99-15406 for SEQ 561,
agtgtaaagggttggagg

SEQ ID NO: 4496 - DNA, 21 bp, Homo Sapiens
  primer_bind 1..21: upstream amplification primer 99-15425 for SEQ 562,
gcattacatcccaattaaaag

SEQ ID NO: 4497 - DNA, 18 bp, Homo Sapiens
  primer_bind 1..18: upstream amplification primer 99-15441 for SEQ 563,
ggtgtatgaatgtgagtg

SEQ ID NO: 4498 - DNA, 19 bp, Homo Sapiens
  primer_bind 1..19: upstream amplification primer 99-15446 for SEQ 564,
taaacatttgagtcttgcc

SEQ ID NO: 4499 - DNA, 20 bp, Homo Sapiens
  primer_bind 1..20: upstream amplification primer 99-15457 for SEQ 565,
gaaatagttacaggtaatgg

SEQ ID NO: 4500 - DNA, 18 bp, Homo Sapiens
  primer_bind 1..18: upstream amplification primer 99-15458 for SEQ 566,
aagggaaaggtgagagtg

SEQ ID NO: 4501 - DNA, 21 bp, Homo Sapiens
  primer_bind 1..21: upstream amplification primer 99-15473 for SEQ 567,
gagaaagttatgtccaaaatg

SEQ ID NO: 4502 - DNA, 20 bp, Homo Sapiens
  primer_bind 1..20: upstream amplification primer 99-15486 for SEQ 568,
tcctctctctatgccgacag

SEQ ID NO: 4503 - DNA, 18 bp, Homo Sapiens
  primer_bind 1..18: upstream amplification primer 99-15489 for SEQ 569,
tgttagctcactgcttgc

SEQ ID NO: 4504 - DNA, 18 bp, Homo Sapiens
  primer_bind 1..18: upstream amplification primer 99-1549 for SEQ 570,
agagaaaggagatgtcac

SEQ ID NO: 4505 - DNA, 18 bp, Homo Sapiens
  primer_bind 1..18: upstream amplification primer 99-15490 for SEQ 571,
aacccccgatgtttccag

SEQ ID NO: 4506 - DNA, 20 bp, Homo Sapiens
  primer_bind 1..20: upstream amplification primer 99-15493 for SEQ 572,
caacttctctttcattttcc

SEQ ID NO: 4507 - DNA, 18 bp, Homo Sapiens
  primer_bind 1..18: upstream amplification primer 99-15500 for SEQ 573,
gaaagacataagtgctcc

SEQ ID NO: 4508 - DNA, 18 bp, Homo Sapiens
  primer_bind 1..18: upstream amplification primer 99-15502 for SEQ 574,
aaagaccccctctaaaac

SEQ ID NO: 4509 - DNA, 18 bp, Homo Sapiens
  primer_bind 1..18: upstream amplification primer 99-15503 for SEQ 575,
gaggcttcatcaatgtag

SEQ ID NO: 4510 - DNA, 20 bp, Homo Sapiens
  primer_bind 1..20: upstream amplification primer 99-15507 for SEQ 576,
gaatgtgtgattgtgtctcc

SEQ ID NO: 4511 - DNA, 18 bp, Homo Sapiens
  primer_bind 1..18: upstream amplification primer 99-15508 for SEQ 577,
ttccacgttttacaggag

SEQ ID NO: 4512 - DNA, 19 bp, Homo Sapiens
  primer_bind 1..19: upstream amplification primer 99-15511 for SEQ 578,
taatcgttgctgtttcttc

SEQ ID NO: 4513 - DNA, 18 bp, Homo Sapiens
  primer_bind 1..18: upstream amplification primer 99-15516 for SEQ 579,
tagggtttcgtcatagtc

SEQ ID NO: 4514 - DNA, 18 bp, Homo Sapiens
  primer_bind 1..18: upstream amplification primer 99-15524 for SEQ 580,
ctgtctgtggtctttctc

SEQ ID NO: 4515 - DNA, 18 bp, Homo Sapiens
  primer_bind 1..18: upstream amplification primer 99-15526 for SEQ 581,
aatgttggatctgctctc

SEQ ID NO: 4516 - DNA, 18 bp, Homo Sapiens
  primer_bind 1..18: upstream amplification primer 99-15527 for SEQ 582,
ctatacctgcttaactcc

SEQ ID NO: 4517 - DNA, 18 bp, Homo Sapiens
  primer_bind 1..18: upstream amplification primer 99-15528 for SEQ 583,
gtaacagaaggagatgag

SEQ ID NO: 4518 - DNA, 20 bp, Homo Sapiens
  primer_bind 1..20: upstream amplification primer 99-1553 for SEQ 584,
gctttaatctggattatggg

SEQ ID NO: 4519 - DNA, 19 bp, Homo Sapiens
  primer_bind 1..19: upstream amplification primer 99-15543 for SEQ 585,
atagtctccattcttactc

SEQ ID NO: 4520 - DNA, 19 bp, Homo Sapiens
  primer_bind 1..19: upstream amplification primer 99-15545 for SEQ 586,
gtgaggaaaatgaaaatgg

SEQ ID NO: 4521 - DNA, 19 bp, Homo Sapiens
  primer_bind 1..19: upstream amplification primer 99-15557 for SEQ 587,
ttttacacagaactaggac

SEQ ID NO: 4522 - DNA, 18 bp, Homo Sapiens
  primer_bind 1..18: upstream amplification primer 99-1557 for SEQ 588,
acttgggttgacagaatc

SEQ ID NO: 4523 - DNA, 18 bp, Homo Sapiens
  primer_bind 1..18: upstream amplification primer 99-15574 for SEQ 589,
aaccactgcacaatatcc

SEQ ID NO: 4524 - DNA, 19 bp, Homo Sapiens
  primer_bind 1..19: upstream amplification primer 99-15575 for SEQ 590,
tatgcttatcatgtctcag

SEQ ID NO: 4525 - DNA, 18 bp, Homo Sapiens
  primer_bind 1..18: upstream amplification primer 99-1558 for SEQ 591,
tgaatcaggcactgtgac

SEQ ID NO: 4526 - DNA, 20 bp, Homo Sapiens
  primer_bind 1..20: upstream amplification primer 99-15595 for SEQ 592,
tccctctccccactttttcc

SEQ ID NO: 4527 - DNA, 18 bp, Homo Sapiens
  primer_bind 1..18: upstream amplification primer 99-15596 for SEQ 593,
tagcatgtagctgaaacc

SEQ ID NO: 4528 - DNA, 19 bp, Homo Sapiens
  primer_bind 1..19: upstream amplification primer 99-15599 for SEQ 594,
gaataactttacttgcctg

SEQ ID NO: 4529 - DNA, 19 bp, Homo Sapiens
  primer_bind 1..19: upstream amplification primer 99-15605 for SEQ 595,
ttctcagccatagataaag

SEQ ID NO: 4530 - DNA, 18 bp, Homo Sapiens
  primer_bind 1..18: upstream amplification primer 99-15606 for SEQ 596,
ttcctgaactgtagaacc

SEQ ID NO: 4531 - DNA, 18 bp, Homo Sapiens
  primer_bind 1..18: upstream amplification primer 99-15625 for SEQ 597,
ctaagtggtctctaagtg

SEQ ID NO: 4532 - DNA, 20 bp, Homo Sapiens
  primer_bind 1..20: upstream amplification primer 99-15627 for SEQ 598,
gtaagaacagagacacaaag

SEQ ID NO: 4533 - DNA, 20 bp, Homo Sapiens
  primer_bind 1..20: upstream amplification primer 99-15636 for SEQ 599,
gattcatgtgcctattagag

SEQ ID NO: 4534 - DNA, 19 bp, Homo Sapiens
  primer_bind 1..19: upstream amplification primer 99-15638 for SEQ 600,
ctaatattcggaaactggc

SEQ ID NO: 4535 - DNA, 19 bp, Homo Sapiens
  primer_bind 1..19: upstream amplification primer 99-15648 for SEQ 601,
ggtgtcctgattgtttttg

SEQ ID NO: 4536 - DNA, 21 bp, Homo Sapiens
  primer_bind 1..21: upstream amplification primer 99-15659 for SEQ 602,
catcatttcataaaaccttcc

SEQ ID NO: 4537 - DNA, 21 bp, Homo Sapiens
  primer_bind 1..21: upstream amplification primer 99-1568 for SEQ 603,
gaaaaagtcaagtttatcctg

SEQ ID NO: 4538 - DNA, 21 bp, Homo Sapiens
  primer_bind 1..21: upstream amplification primer 99-15705 for SEQ 604,
gctttagtttcctctacaacc

SEQ ID NO: 4539 - DNA, 19 bp, Homo Sapiens
  primer_bind 1..19: upstream amplification primer 99-15717 for SEQ 605,
aagttagggtgataagaag

SEQ ID NO: 4540 - DNA, 18 bp, Homo Sapiens
  primer_bind 1..18: upstream amplification primer 99-15718 for SEQ 606,
atatgtctcctctgactc

SEQ ID NO: 4541 - DNA, 19 bp, Homo Sapiens
  primer_bind 1..19: upstream amplification primer 99-1572 for SEQ 607,
ataatgtaagagatgtggg

SEQ ID NO: 4542 - DNA, 19 bp, Homo Sapiens
  primer_bind 1..19: upstream amplification primer 99-15728 for SEQ 608,
atatttacctggagagaac

SEQ ID NO: 4543 - DNA, 19 bp, Homo Sapiens
  primer_bind 1..19: upstream amplification primer 99-15739 for SEQ 609,
ggggaactgatattttttg

SEQ ID NO: 4544 - DNA, 19 bp, Homo Sapiens
  primer_bind 1..19: upstream amplification primer 99-15744 for SEQ 610,
gtgtcatagttagaaaggc

SEQ ID NO: 4545 - DNA, 19 bp, Homo Sapiens
  primer_bind 1..19: upstream amplification primer 99-15747 for SEQ 611,
tcttccaatatatgtgacc

SEQ ID NO: 4546 - DNA, 18 bp, Homo Sapiens
  primer_bind 1..18: upstream amplification primer 99-15748 for SEQ 612,
gtaaggattcagtcagtg

SEQ ID NO: 4547 - DNA, 20 bp, Homo Sapiens
  primer_bind 1..20: upstream amplification primer 99-15756 for SEQ 613,
ggaagagaagagaaataatg

SEQ ID NO: 4548 - DNA, 18 bp, Homo Sapiens
  primer_bind 1..18: upstream amplification primer 99-15758 for SEQ 614,
aaacctgttagacatgcc

SEQ ID NO: 4549 - DNA, 19 bp, Homo Sapiens
  primer_bind 1..19: upstream amplification primer 99-15762 for SEQ 615,
tgccaagctagaaagtgcc

SEQ ID NO: 4550 - DNA, 19 bp, Homo Sapiens
  primer_bind 1..19: upstream amplification primer 99-1577 for SEQ 616,
ttgggcaaggaaagaggac

SEQ ID NO: 4551 - DNA, 19 bp, Homo Sapiens
  primer_bind 1..19: upstream amplification primer 99-15774 for SEQ 617,
aatggataaggagtatgtg

SEQ ID NO: 4552 - DNA, 19 bp, Homo Sapiens
  primer_bind 1..19: upstream amplification primer 99-15776 for SEQ 618,
cttggatctcaaatcctac

SEQ ID NO: 4553 - DNA, 18 bp, Homo Sapiens
  primer_bind 1..18: upstream amplification primer 99-1578 for SEQ 619,
atcatcccccatgaaaac

SEQ ID NO: 4554 - DNA, 19 bp, Homo Sapiens
  primer_bind 1..19: upstream amplification primer 99-15798 for SEQ 620,
cagtctttctactcagcag

SEQ ID NO: 4555 - DNA, 21 bp, Homo Sapiens
  primer_bind 1..21: upstream amplification primer 99-15803 for SEQ 621,
gatgagaaaaaatgaggaaac

SEQ ID NO: 4556 - DNA, 20 bp, Homo Sapiens
  primer_bind 1..20: upstream amplification primer 99-15805 for SEQ 622,
catctgtgaactattaaagg

SEQ ID NO: 4557 - DNA, 19 bp, Homo Sapiens
  primer_bind 1..19: upstream amplification primer 99-1582 for SEQ 623,
cagcactactgataaattg

SEQ ID NO: 4558 - DNA, 19 bp, Homo Sapiens
  primer_bind 1..19: upstream amplification primer 99-15826 for SEQ 624,
gtttcaaaaccagctattg

SEQ ID NO: 4559 - DNA, 18 bp, Homo Sapiens
  primer_bind 1..18: upstream amplification primer 99-15830 for SEQ 625,
tagctttccctgcattcc

SEQ ID NO: 4560 - DNA, 20 bp, Homo Sapiens
  primer_bind 1..20: upstream amplification primer 99-1585 for SEQ 626,
cctgcaacatttttaatgtg

SEQ ID NO: 4561 - DNA, 21 bp, Homo Sapiens
  primer_bind 1..21: upstream amplification primer 99-1587 for SEQ 627,
taatggtagttgatgaggtcc

SEQ ID NO: 4562 - DNA, 21 bp, Homo Sapiens
  primer_bind 1..21: upstream amplification primer 99-15891 for SEQ 628,
ttttttcaggagcctaccttg

SEQ ID NO: 4563 - DNA, 21 bp, Homo Sapiens
  primer_bind 1..21: upstream amplification primer 99-15910 for SEQ 629,
ctcaattattgtttgcacaag

SEQ ID NO: 4564 - DNA, 20 bp, Homo Sapiens
  primer_bind 1..20: upstream amplification primer 99-15916 for SEQ 630,
cagagtggttttgatgatac

SEQ ID NO: 4565 - DNA, 20 bp, Homo Sapiens
  primer_bind 1..20: upstream amplification primer 99-15925 for SEQ 631,
gaaaggacctttgaagcaac

SEQ ID NO: 4566 - DNA, 20 bp, Homo Sapiens
  primer_bind 1..20: upstream amplification primer 99-15947 for SEQ 632,
tcaataccaggtcacttggc

SEQ ID NO: 4567 - DNA, 20 bp, Homo Sapiens
  primer_bind 1..20: upstream amplification primer 99-15965 for SEQ 633,
gaaaaacagaaacacacaac

SEQ ID NO: 4568 - DNA, 19 bp, Homo Sapiens
  primer_bind 1..19: upstream amplification primer 99-15966 for SEQ 634,
aaccatatacaacttccac

SEQ ID NO: 4569 - DNA, 18 bp, Homo Sapiens
  primer_bind 1..18: upstream amplification primer 99-15968 for SEQ 635,
tctggagtcattactggg

SEQ ID NO: 4570 - DNA, 19 bp, Homo Sapiens
  primer_bind 1..19: upstream amplification primer 99-1597 for SEQ 636,
tttaagatgccaagttgtc

SEQ ID NO: 4571 - DNA, 19 bp, Homo Sapiens
  primer_bind 1..19: upstream amplification primer 99-15970 for SEQ 637,
tccaagacattaattgccc

SEQ ID NO: 4572 - DNA, 20 bp, Homo Sapiens
  primer_bind 1..20: upstream amplification primer 99-15973 for SEQ 638,
cgaaggtttgtagagttttg

SEQ ID NO: 4573 - DNA, 18 bp, Homo Sapiens
  primer_bind 1..18: upstream amplification primer 99-15981 for SEQ 639,
gagaacagaggttttggg

SEQ ID NO: 4574 - DNA, 21 bp, Homo Sapiens
  primer_bind 1..21: upstream amplification primer 99-15985 for SEQ 640,
catttaatagctcttaactcc

SEQ ID NO: 4575 - DNA, 18 bp, Homo Sapiens
  primer_bind 1..18: upstream amplification primer 99-15992 for SEQ 641,
tgtgtctctacccttgtc

SEQ ID NO: 4576 - DNA, 18 bp, Homo Sapiens
  primer_bind 1..18: upstream amplification primer 99-15996 for SEQ 642,
tggctttacacataaggc

SEQ ID NO: 4577 - DNA, 18 bp, Homo Sapiens
  primer_bind 1..18: upstream amplification primer 99-16003 for SEQ 643,
gctgccgtaatgtattcc

SEQ ID NO: 4578 - DNA, 18 bp, Homo Sapiens
  primer_bind 1..18: upstream amplification primer 99-16005 for SEQ 644,
tcttgtagacttcaggtg

SEQ ID NO: 4579 - DNA, 18 bp, Homo Sapiens
  primer_bind 1..18: upstream amplification primer 99-1601 for SEQ 645,
ttggcttggcagggcaac

SEQ ID NO: 4580 - DNA, 19 bp, Homo Sapiens
  primer_bind 1..19: upstream amplification primer 99-1602 for SEQ 646,
atccttccaaacttttctc

SEQ ID NO: 4581 - DNA, 18 bp, Homo Sapiens
  primer_bind 1..18: upstream amplification primer 99-16022 for SEQ 647,
atctgggtggaaaaggac

SEQ ID NO: 4582 - DNA, 18 bp, Homo Sapiens
  primer_bind 1..18: upstream amplification primer 99-16023 for SEQ 648,
agtgagaccctaagaacc

SEQ ID NO: 4583 - DNA, 19 bp, Homo Sapiens
  primer_bind 1..19: upstream amplification primer 99-16030 for SEQ 649,
taaggaaagtgtggcaccc

SEQ ID NO: 4584 - DNA, 21 bp, Homo Sapiens
  primer_bind 1..21: upstream amplification primer 99-1605 for SEQ 650,
gaaatcagacttacagcaatg

SEQ ID NO: 4585 - DNA, 19 bp, Homo Sapiens
  primer_bind 1..19: upstream amplification primer 99-1607 for SEQ 651,
gttgggaagagttttgtag

SEQ ID NO: 4586 - DNA, 18 bp, Homo Sapiens
  primer_bind 1..18: upstream amplification primer 99-1611 for SEQ 652,
catggaatgcaactttgg

SEQ ID NO: 4587 - DNA, 19 bp, Homo Sapiens
  primer_bind 1..19: upstream amplification primer 99-16121 for SEQ 653,
gacaaaaacgtgttcaaag

SEQ ID NO: 4588 - DNA, 19 bp, Homo Sapiens
  primer_bind 1..19: upstream amplification primer 99-16128 for SEQ 654,
aaagttatcaggtgagtag

SEQ ID NO: 4589 - DNA, 20 bp, Homo Sapiens
  primer_bind 1..20: upstream amplification primer 99-16129 for SEQ 655,
gatgaggacttagatttcac

SEQ ID NO: 4590 - DNA, 19 bp, Homo Sapiens
  primer_bind 1..19: upstream amplification primer 99-16139 for SEQ 656,
ggatcagatatttacatgc

SEQ ID NO: 4591 - DNA, 21 bp, Homo Sapiens
  primer_bind 1..21: upstream amplification primer 99-16140 for SEQ 657,
gatattagacttttaagcacc

SEQ ID NO: 4592 - DNA, 19 bp, Homo Sapiens
  primer_bind 1..19: upstream amplification primer 99-1615 for SEQ 658,
tgctggtatgaaattgttg

SEQ ID NO: 4593 - DNA, 19 bp, Homo Sapiens
  primer_bind 1..19: upstream amplification primer 99-16166 for SEQ 659,
ccctccttgtattttgttc

SEQ ID NO: 4594 - DNA, 19 bp, Homo Sapiens
  primer_bind 1..19: upstream amplification primer 99-16167 for SEQ 660,
atgcgaattaatgtgtctg

SEQ ID NO: 4595 - DNA, 21 bp, Homo Sapiens
  primer_bind 1..21: upstream amplification primer 99-16188 for SEQ 661,
agctgttagtagcttaaattg

SEQ ID NO: 4596 - DNA, 19 bp, Homo Sapiens
  primer_bind 1..19: upstream amplification primer 99-16192 for SEQ 662,
gttctcagcaaacattatc

SEQ ID NO: 4597 - DNA, 18 bp, Homo Sapiens
  primer_bind 1..18: upstream amplification primer 99-16198 for SEQ 663,
ctatatctggcagtatgg

SEQ ID NO: 4598 - DNA, 18 bp, Homo Sapiens
  primer_bind 1..18: upstream amplification primer 99-16202 for SEQ 664,
acccctaatgtctttacc

SEQ ID NO: 4599 - DNA, 18 bp, Homo Sapiens
  primer_bind 1..18: upstream amplification primer 99-16205 for SEQ 665,
gtcgtttagcatagatcc

SEQ ID NO: 4600 - DNA, 19 bp, Homo Sapiens
  primer_bind 1..19: upstream amplification primer 99-16210 for SEQ 666,
caaaaccagactgaaatcc

SEQ ID NO: 4601 - DNA, 18 bp, Homo Sapiens
  primer_bind 1..18: upstream amplification primer 99-1622 for SEQ 667,
cttcctcaactcttctac

SEQ ID NO: 4602 - DNA, 19 bp, Homo Sapiens
  primer_bind 1..19: upstream amplification primer 99-16221 for SEQ 668,
ctaagagttcgtggttttg

SEQ ID NO: 4603 - DNA, 20 bp, Homo Sapiens
  primer_bind 1..20: upstream amplification primer 99-16227 for SEQ 669,
atgaataaatttgaggggtc

SEQ ID NO: 4604 - DNA, 20 bp, Homo Sapiens
  primer_bind 1..20: upstream amplification primer 99-1623 for SEQ 670,
tacttttaactcctctcgcc

SEQ ID NO: 4605 - DNA, 19 bp, Homo Sapiens
  primer_bind 1..19: upstream amplification primer 99-16247 for SEQ 671,
ctccaccacacaaaattac

SEQ ID NO: 4606 - DNA, 19 bp, Homo Sapiens
  primer_bind 1..19: upstream amplification primer 99-16254 for SEQ 672,
gagagagattttaccttcc

SEQ ID NO: 4607 - DNA, 19 bp, Homo Sapiens
  primer_bind 1..19: upstream amplification primer 99-16260 for SEQ 673,
ttattcttcttggcgtttc

SEQ ID NO: 4608 - DNA, 20 bp, Homo Sapiens
  primer_bind 1..20: upstream amplification primer 99-16262 for SEQ 674,
ctgagaacatttattaaggg

SEQ ID NO: 4609 - DNA, 18 bp, Homo Sapiens
  primer_bind 1..18: upstream amplification primer 99-16265 for SEQ 675,
tggctttgggaacttttg

SEQ ID NO: 4610 - DNA, 19 bp, Homo Sapiens
  primer_bind 1..19: upstream amplification primer 99-16279 for SEQ 676,
ctcccatttaccttatttg

SEQ ID NO: 4611 - DNA, 18 bp, Homo Sapiens
  primer_bind 1..18: upstream amplification primer 99-16308 for SEQ 677,
cactctacttgggttttc

SEQ ID NO: 4612 - DNA, 18 bp, Homo Sapiens
  primer_bind 1..18: upstream amplification primer 99-16346 for SEQ 678,
aactactgggaggaaagg

SEQ ID NO: 4613 - DNA, 19 bp, Homo Sapiens
  primer_bind 1..19: upstream amplification primer 99-16366 for SEQ 679,
gcctcagtgaatgtttgtg

SEQ ID NO: 4614 - DNA, 20 bp, Homo Sapiens
  primer_bind 1..20: upstream amplification primer 99-1637 for SEQ 680,
gttttctaaacatcgtttgg

SEQ ID NO: 4615 - DNA, 19 bp, Homo Sapiens
  primer_bind 1..19: upstream amplification primer 99-16375 for SEQ 681,
ttgtgtattagtgatgagg

SEQ ID NO: 4616 - DNA, 19 bp, Homo Sapiens
  primer_bind 1..19: upstream amplification primer 99-1638 for SEQ 682,
gaggaaaatggattgtgag

SEQ ID NO: 4617 - DNA, 21 bp, Homo Sapiens
  primer_bind 1..21: upstream amplification primer 99-16386 for SEQ 683,
cctaagaacatccagcatttg

SEQ ID NO: 4618 - DNA, 19 bp, Homo Sapiens
  primer_bind 1..19: upstream amplification primer 99-16396 for SEQ 684,
ttattgtgagtggagaatg

SEQ ID NO: 4619 - DNA, 19 bp, Homo Sapiens
  primer_bind 1..19: upstream amplification primer 99-16399 for SEQ 685,
tgttgttatagcactaagg

SEQ ID NO: 4620 - DNA, 18 bp, Homo Sapiens
  primer_bind 1..18: upstream amplification primer 99-16403 for SEQ 686,
aggatgaggaaggcagtg

SEQ ID NO: 4621 - DNA, 19 bp, Homo Sapiens
  primer_bind 1..19: upstream amplification primer 99-16407 for SEQ 687,
aaatgttcctcaggtagtc

SEQ ID NO: 4622 - DNA, 19 bp, Homo Sapiens
  primer_bind 1..19: upstream amplification primer 99-16409 for SEQ 688,
tgggggagcacattcatag

SEQ ID NO: 4623 - DNA, 18 bp, Homo Sapiens
  primer_bind 1..18: upstream amplification primer 99-16414 for SEQ 689,
ttcatactgcttcttccc

SEQ ID NO: 4624 - DNA, 20 bp, Homo Sapiens
  primer_bind 1..20: upstream amplification primer 99-16445 for SEQ 690,
cactcatttatatccattcc

SEQ ID NO: 4625 - DNA, 19 bp, Homo Sapiens
  primer_bind 1..19: upstream amplification primer 99-16466 for SEQ 691,
agtgctgtaagaagttatc

SEQ ID NO: 4626 - DNA, 19 bp, Homo Sapiens
  primer_bind 1..19: upstream amplification primer 99-16474 for SEQ 692,
aaatacgagagaggcagac

SEQ ID NO: 4627 - DNA, 21 bp, Homo Sapiens
  primer_bind 1..21: upstream amplification primer 99-16500 for SEQ 693,
ctctatttagttgtcctattc

SEQ ID NO: 4628 - DNA, 19 bp, Homo Sapiens
  primer_bind 1..19: upstream amplification primer 99-16505 for SEQ 694,
gtggtgaaagaaaatgaag

SEQ ID NO: 4629 - DNA, 19 bp, Homo Sapiens
  primer_bind 1..19: upstream amplification primer 99-16526 for SEQ 695,
ccttcatcaagacactaac

SEQ ID NO: 4630 - DNA, 18 bp, Homo Sapiens
  primer_bind 1..18: upstream amplification primer 99-16528 for SEQ 696,
ggaactatgggaagacac

SEQ ID NO: 4631 - DNA, 20 bp, Homo Sapiens
  primer_bind 1..20: upstream amplification primer 99-16531 for SEQ 697,
caggacttcattcaataaac

SEQ ID NO: 4632 - DNA, 18 bp, Homo Sapiens
  primer_bind 1..18: upstream amplification primer 99-16535 for SEQ 698,
taataggggtcttctctg

SEQ ID NO: 4633 - DNA, 19 bp, Homo Sapiens
  primer_bind 1..19: upstream amplification primer 99-16559 for SEQ 699,
gaataaagctactattggg

SEQ ID NO: 4634 - DNA, 19 bp, Homo Sapiens
  primer_bind 1..19: upstream amplification primer 99-16562 for SEQ 700,
cactttgaatgagactaac

SEQ ID NO: 4635 - DNA, 19 bp, Homo Sapiens
  primer_bind 1..19: upstream amplification primer 99-16563 for SEQ 701,
tctctcatttccctctatc

SEQ ID NO: 4636 - DNA, 19 bp, Homo Sapiens
  primer_bind 1..19: upstream amplification primer 99-16564 for SEQ 702,
tgtagaaattttgcctctc

SEQ ID NO: 4637 - DNA, 19 bp, Homo Sapiens
  primer_bind 1..19: upstream amplification primer 99-16568 for SEQ 703,
aatgcctcattatctgttg

SEQ ID NO: 4638 - DNA, 18 bp, Homo Sapiens
  primer_bind 1..18: upstream amplification primer 99-16569 for SEQ 704,
tgatgtcctacctgattc

SEQ ID NO: 4639 - DNA, 20 bp, Homo Sapiens
  primer_bind 1..20: upstream amplification primer 99-1658 for SEQ 705,
ctgaatatactgactgcttg

SEQ ID NO: 4640 - DNA, 18 bp, Homo Sapiens
  primer_bind 1..18: upstream amplification primer 99-16611 for SEQ 706,
ctttggggtgtctgtttc

SEQ ID NO: 4641 - DNA, 20 bp, Homo Sapiens
  primer_bind 1..20: upstream amplification primer 99-1664 for SEQ 707,
ctcctaattgatctcattcc

SEQ ID NO: 4642 - DNA, 19 bp, Homo Sapiens
  primer_bind 1..19: upstream amplification primer 99-16655 for SEQ 708,
aaacacaagcaactttgac

SEQ ID NO: 4643 - DNA, 18 bp, Homo Sapiens
  primer_bind 1..18: upstream amplification primer 99-16657 for SEQ 709,
cctacttatctccattcc

SEQ ID NO: 4644 - DNA, 19 bp, Homo Sapiens
  primer_bind 1..19: upstream amplification primer 99-16677 for SEQ 710,
aatgggaaattagagagag

SEQ ID NO: 4645 - DNA, 20 bp, Homo Sapiens
  primer_bind 1..20: upstream amplification primer 99-16683 for SEQ 711,
cttttctcatcttaaaaccc

SEQ ID NO: 4646 - DNA, 18 bp, Homo Sapiens
  primer_bind 1..18: upstream amplification primer 99-16692 for SEQ 712,
gatttacaacctacccag

SEQ ID NO: 4647 - DNA, 19 bp, Homo Sapiens
  primer_bind 1..19: upstream amplification primer 99-16697 for SEQ 713,
acccatagaaaagttgaag

SEQ ID NO: 4648 - DNA, 18 bp, Homo Sapiens
  primer_bind 1..18: upstream amplification primer 99-16708 for SEQ 714,
gggtttttcatactcagg

SEQ ID NO: 4649 - DNA, 18 bp, Homo Sapiens
  primer_bind 1..18: upstream amplification primer 99-16740 for SEQ 715,
gttcctctgtttctcctc

SEQ ID NO: 4650 - DNA, 19 bp, Homo Sapiens
  primer_bind 1..19: upstream amplification primer 99-16768 for SEQ 716,
gcttgttggactaaacttg

SEQ ID NO: 4651 - DNA, 18 bp, Homo Sapiens
  primer_bind 1..18: upstream amplification primer 99-16801 for SEQ 717,
tttaaaacctgagggtgg

SEQ ID NO: 4652 - DNA, 18 bp, Homo Sapiens
  primer_bind 1..18: upstream amplification primer 99-16827 for SEQ 718,
tgcctgagcctaaactac

SEQ ID NO: 4653 - DNA, 19 bp, Homo Sapiens
  primer_bind 1..19: upstream amplification primer 99-16838 for SEQ 719,
tctgtcttgctggggatac

SEQ ID NO: 4654 - DNA, 19 bp, Homo Sapiens
  primer_bind 1..19: upstream amplification primer 99-16841 for SEQ 720,
gtagtaatggatttctggg

SEQ ID NO: 4655 - DNA, 20 bp, Homo Sapiens
  primer_bind 1..20: upstream amplification primer 99-16842 for SEQ 721,
agaagaggcttgctgagagg

SEQ ID NO: 4656 - DNA, 19 bp, Homo Sapiens
  primer_bind 1..19: upstream amplification primer 99-16845 for SEQ 722,
cactcttcagttgctggtc

SEQ ID NO: 4657 - DNA, 18 bp, Homo Sapiens
  primer_bind 1..18: upstream amplification primer 99-16847 for SEQ 723,
attgaaggagagaaggtg

SEQ ID NO: 4658 - DNA, 20 bp, Homo Sapiens
  primer_bind 1..20: upstream amplification primer 99-16855 for SEQ 724,
cttttctggtaaagtacagg

SEQ ID NO: 4659 - DNA, 19 bp, Homo Sapiens
  primer_bind 1..19: upstream amplification primer 99-16867 for SEQ 725,
tcttcagcaatgccaggtg

SEQ ID NO: 4660 - DNA, 18 bp, Homo Sapiens
  primer_bind 1..18: upstream amplification primer 99-16873 for SEQ 726,
ctgcatttctttggcttg

SEQ ID NO: 4661 - DNA, 19 bp, Homo Sapiens
  primer_bind 1..19: upstream amplification primer 99-16886 for SEQ 727,
tcaagcaaaaactaagacc

SEQ ID NO: 4662 - DNA, 18 bp, Homo Sapiens
  primer_bind 1..18: upstream amplification primer 99-16891 for SEQ 728,
gtatcaggacactaaagg

SEQ ID NO: 4663 - DNA, 19 bp, Homo Sapiens
  primer_bind 1..19: upstream amplification primer 99-16894 for SEQ 729,
tagttacagtttcacttgg

SEQ ID NO: 4664 - DNA, 18 bp, Homo Sapiens
  primer_bind 1..18: upstream amplification primer 99-16895 for SEQ 730,
cacctctaacaatcaacc

SEQ ID NO: 4665 - DNA, 20 bp, Homo Sapiens
  primer_bind 1..20: upstream amplification primer 99-16903 for SEQ 731,
gaacttcagagttccaatag

SEQ ID NO: 4666 - DNA, 20 bp, Homo Sapiens
  primer_bind 1..20: upstream amplification primer 99-16905 for SEQ 732,
agagtacggagctaaagctg

SEQ ID NO: 4667 - DNA, 18 bp, Homo Sapiens
  primer_bind 1..18: upstream amplification primer 99-16906 for SEQ 733,
atcccctttgttgtcctg

SEQ ID NO: 4668 - DNA, 18 bp, Homo Sapiens
  primer_bind 1..18: upstream amplification primer 99-16913 for SEQ 734,
ggactggctgttatcttg

SEQ ID NO: 4669 - DNA, 18 bp, Homo Sapiens
  primer_bind 1..18: upstream amplification primer 99-16914 for SEQ 735,
gatttttctcatgccagc

SEQ ID NO: 4670 - DNA, 18 bp, Homo Sapiens
  primer_bind 1..18: upstream amplification primer 99-16929 for SEQ 736,
caggtcagagaacaaagg

SEQ ID NO: 4671 - DNA, 19 bp, Homo Sapiens
  primer_bind 1..19: upstream amplification primer 99-16930 for SEQ 737,
tataaattcgtgactctgg

SEQ ID NO: 4672 - DNA, 18 bp, Homo Sapiens
  primer_bind 1..18: upstream amplification primer 99-16933 for SEQ 738,
cacccatcttttctttcc

SEQ ID NO: 4673 - DNA, 18 bp, Homo Sapiens
  primer_bind 1..18: upstream amplification primer 99-16946 for SEQ 739,
ggtggaggtgcttaattg

SEQ ID NO: 4674 - DNA, 19 bp, Homo Sapiens
  primer_bind 1..19: upstream amplification primer 99-16948 for SEQ 740,
ttaaaagaggggaactaac

SEQ ID NO: 4675 - DNA, 18 bp, Homo Sapiens
  primer_bind 1..18: upstream amplification primer 99-16952 for SEQ 741,
ggagatagtggagaaaag

SEQ ID NO: 4676 - DNA, 19 bp, Homo Sapiens
  primer_bind 1..19: upstream amplification primer 99-16975 for SEQ 742,
ggttaagacaaaagtagag

SEQ ID NO: 4677 - DNA, 18 bp, Homo Sapiens
  primer_bind 1..18: upstream amplification primer 99-16979 for SEQ 743,
taacaccaacattcagcc

SEQ ID NO: 4678 - DNA, 18 bp, Homo Sapiens
  primer_bind 1..18: upstream amplification primer 99-16990 for SEQ 744,
tggaaaaggtttggagag

SEQ ID NO: 4679 - DNA, 18 bp, Homo Sapiens
  primer_bind 1..18: upstream amplification primer 99-16994 for SEQ 745,
ccccacacctattttctc

SEQ ID NO: 4680 - DNA, 20 bp, Homo Sapiens
  primer_bind 1..20: upstream amplification primer 99-17001 for SEQ 746,
tcaacctccacagcccttac

SEQ ID NO: 4681 - DNA, 18 bp, Homo Sapiens
  primer_bind 1..18: upstream amplification primer 99-17008 for SEQ 747,
acaagtcccccacataac

SEQ ID NO: 4682 - DNA, 18 bp, Homo Sapiens
  primer_bind 1..18: upstream amplification primer 99-1701 for SEQ 748,
cattcacagtcactctgg

SEQ ID NO: 4683 - DNA, 18 bp, Homo Sapiens
  primer_bind 1..18: upstream amplification primer 99-17013 for SEQ 749,
ttggtgaaggggttatag

SEQ ID NO: 4684 - DNA, 21 bp, Homo Sapiens
  primer_bind 1..21: upstream amplification primer 99-17016 for SEQ 750,
cacaagatgaatttgatgaac

SEQ ID NO: 4685 - DNA, 19 bp, Homo Sapiens
  primer_bind 1..19: upstream amplification primer 99-17028 for SEQ 751,
aatggaaaggtcaggcagg

SEQ ID NO: 4686 - DNA, 18 bp, Homo Sapiens
  primer_bind 1..18: upstream amplification primer 99-17045 for SEQ 752,
tcatcatcatccctttcc

SEQ ID NO: 4687 - DNA, 20 bp, Homo Sapiens
  primer_bind 1..20: upstream amplification primer 99-17048 for SEQ 753,
cagaaggcttttgttctttg

SEQ ID NO: 4688 - DNA, 19 bp, Homo Sapiens
  primer_bind 1..19: upstream amplification primer 99-17052 for SEQ 754,
tgatgatgtggggagtagg

SEQ ID NO: 4689 - DNA, 19 bp, Homo Sapiens
  primer_bind 1..19: upstream amplification primer 99-17062 for SEQ 755,
aaaccttaaacttccagac

SEQ ID NO: 4690 - DNA, 20 bp, Homo Sapiens
  primer_bind 1..20: upstream amplification primer 99-17065 for SEQ 756,
gcataatttcataagctgtc

SEQ ID NO: 4691 - DNA, 19 bp, Homo Sapiens
  primer_bind 1..19: upstream amplification primer 99-17084 for SEQ 757,
tgaccaatacatcaagctg

SEQ ID NO: 4692 - DNA, 19 bp, Homo Sapiens
  primer_bind 1..19: upstream amplification primer 99-1709 for SEQ 758,
tgaaagctgttttctgagg

SEQ ID NO: 4693 - DNA, 19 bp, Homo Sapiens
  primer_bind 1..19: upstream amplification primer 99-17094 for SEQ 759,
atctacacacagattatcc

SEQ ID NO: 4694 - DNA, 18 bp, Homo Sapiens
  primer_bind 1..18: upstream amplification primer 99-17095 for SEQ 760,
caacagaacaggaaagag

SEQ ID NO: 4695 - DNA, 19 bp, Homo Sapiens
  primer_bind 1..19: upstream amplification primer 99-1710 for SEQ 761,
gtgtggtgattgttttatg

SEQ ID NO: 4696 - DNA, 19 bp, Homo Sapiens
  primer_bind 1..19: upstream amplification primer 99-17103 for SEQ 762,
tttgagtgtgcaacacggg

SEQ ID NO: 4697 - DNA, 18 bp, Homo Sapiens
  primer_bind 1..18: upstream amplification primer 99-17105 for SEQ 763,
gcacagacttcaaagagg

SEQ ID NO: 4698 - DNA, 19 bp, Homo Sapiens
  primer_bind 1..19: upstream amplification primer 99-17112 for SEQ 764,
taccttaccatttcctaac

SEQ ID NO: 4699 - DNA, 18 bp, Homo Sapiens
  primer_bind 1..18: upstream amplification primer 99-17122 for SEQ 765,
aattgatatgctcgaccc

SEQ ID NO: 4700 - DNA, 19 bp, Homo Sapiens
  primer_bind 1..19: upstream amplification primer 99-17123 for SEQ 766,
cggataggacttattaagg

SEQ ID NO: 4701 - DNA, 19 bp, Homo Sapiens
  primer_bind 1..19: upstream amplification primer 99-17133 for SEQ 767,
acttccctgtcagtcatcc

SEQ ID NO: 4702 - DNA, 19 bp, Homo Sapiens
  primer_bind 1..19: upstream amplification primer 99-17134 for SEQ 768,
ctactgtccagaataaacc

SEQ ID NO: 4703 - DNA, 18 bp, Homo Sapiens
  primer_bind 1..18: upstream amplification primer 99-17136 for SEQ 769,
tctggggttcttatcctg

SEQ ID NO: 4704 - DNA, 18 bp, Homo Sapiens
  primer_bind 1..18: upstream amplification primer 99-17154 for SEQ 770,
gcaacttcatttacggtg

SEQ ID NO: 4705 - DNA, 18 bp, Homo Sapiens
  primer_bind 1..18: upstream amplification primer 99-17157 for SEQ 771,
catgaaagccaagagctg

SEQ ID NO: 4706 - DNA, 19 bp, Homo Sapiens
  primer_bind 1..19: upstream amplification primer 99-17159 for SEQ 772,
tgtggtccattaccatgag

SEQ ID NO: 4707 - DNA, 18 bp, Homo Sapiens
  primer_bind 1..18: upstream amplification primer 99-17164 for SEQ 773,
agataatcccgtgttgag

SEQ ID NO: 4708 - DNA, 18 bp, Homo Sapiens
  primer_bind 1..18: upstream amplification primer 99-17165 for SEQ 774,
atgggcaggaacattcag

SEQ ID NO: 4709 - DNA, 18 bp, Homo Sapiens
  primer_bind 1..18: upstream amplification primer 99-17169 for SEQ 775,
ctcccaggaaattctcac

SEQ ID NO: 4710 - DNA, 18 bp, Homo Sapiens
  primer_bind 1..18: upstream amplification primer 99-17176 for SEQ 776,
tgtcatgctatgtgactg

SEQ ID NO: 4711 - DNA, 19 bp, Homo Sapiens
  primer_bind 1..19: upstream amplification primer 99-17180 for SEQ 777,
gtatctgtctacactgatg

SEQ ID NO: 4712 - DNA, 19 bp, Homo Sapiens
  primer_bind 1..19: upstream amplification primer 99-17204 for SEQ 778,
ttcatctcctgccactacc

SEQ ID NO: 4713 - DNA, 18 bp, Homo Sapiens
  primer_bind 1..18: upstream amplification primer 99-17205 for SEQ 779,
ccatgatggtcttttggg

SEQ ID NO: 4714 - DNA, 19 bp, Homo Sapiens
  primer_bind 1..19: upstream amplification primer 99-17213 for SEQ 780,
tatgttgtgccattttctc

SEQ ID NO: 4715 - DNA, 21 bp, Homo Sapiens
  primer_bind 1..21: upstream amplification primer 99-1723 for SEQ 781,
ccaatcaatgaataagagatg

SEQ ID NO: 4716 - DNA, 21 bp, Homo Sapiens
  primer_bind 1..21: upstream amplification primer 99-17253 for SEQ 782,
cattcattacgagttgtctgg

SEQ ID NO: 4717 - DNA, 20 bp, Homo Sapiens
  primer_bind 1..20: upstream amplification primer 99-17262 for SEQ 783,
gacatataggtaagaaactg

SEQ ID NO: 4718 - DNA, 20 bp, Homo Sapiens
  primer_bind 1..20: upstream amplification primer 99-17274 for SEQ 784,
caaattaatcttcccagacc

SEQ ID NO: 4719 - DNA, 18 bp, Homo Sapiens
  primer_bind 1..18: upstream amplification primer 99-17282 for SEQ 785,
gaggtatgatagtccaag

SEQ ID NO: 4720 - DNA, 18 bp, Homo Sapiens
  primer_bind 1..18: upstream amplification primer 99-17306 for SEQ 786,
ataccaactatgcccaac

SEQ ID NO: 4721 - DNA, 19 bp, Homo Sapiens
  primer_bind 1..19: upstream amplification primer 99-17315 for SEQ 787,
aaagtgctgacactgaggc

SEQ ID NO: 4722 - DNA, 19 bp, Homo Sapiens
  primer_bind 1..19: upstream amplification primer 99-17343 for SEQ 788,
gttttcatggttaccatag

SEQ ID NO: 4723 - DNA, 18 bp, Homo Sapiens
  primer_bind 1..18: upstream amplification primer 99-17347 for SEQ 789,
gcctttctgccttttgtg

SEQ ID NO: 4724 - DNA, 19 bp, Homo Sapiens
  primer_bind 1..19: upstream amplification primer 99-17351 for SEQ 790,
gggcagtagaaaaaaacag

SEQ ID NO: 4725 - DNA, 19 bp, Homo Sapiens
  primer_bind 1..19: upstream amplification primer 99-17352 for SEQ 791,
acaataatgatagggacac

SEQ ID NO: 4726 - DNA, 18 bp, Homo Sapiens
  primer_bind 1..18: upstream amplification primer 99-17357 for SEQ 792,
gcccctgtttttcttatc

SEQ ID NO: 4727 - DNA, 18 bp, Homo Sapiens
  primer_bind 1..18: upstream amplification primer 99-17363 for SEQ 793,
ttggagaagaggtttgtg

SEQ ID NO: 4728 - DNA, 18 bp, Homo Sapiens
  primer_bind 1..18: upstream amplification primer 99-17365 for SEQ 794,
gatgccctgatgtaactg

SEQ ID NO: 4729 - DNA, 18 bp, Homo Sapiens
  primer_bind 1..18: upstream amplification primer 99-17375 for SEQ 795,
ttgggtaggagtatgatg

SEQ ID NO: 4730 - DNA, 19 bp, Homo Sapiens
  primer_bind 1..19: upstream amplification primer 99-1738 for SEQ 796,
agaaagactaaagccaacc

SEQ ID NO: 4731 - DNA, 20 bp, Homo Sapiens
  primer_bind 1..20: upstream amplification primer 99-17389 for SEQ 797,
gtcccttgtttagaataatg

SEQ ID NO: 4732 - DNA, 18 bp, Homo Sapiens
  primer_bind 1..18: upstream amplification primer 99-1739 for SEQ 798,
tatgaaatgctgaggctg

SEQ ID NO: 4733 - DNA, 18 bp, Homo Sapiens
  primer_bind 1..18: upstream amplification primer 99-17409 for SEQ 799,
atagatcctgtcacactg

SEQ ID NO: 4734 - DNA, 19 bp, Homo Sapiens
  primer_bind 1..19: upstream amplification primer 99-17412 for SEQ 800,
tgatggggacagaggaatc

SEQ ID NO: 4735 - DNA, 18 bp, Homo Sapiens
  primer_bind 1..18: upstream amplification primer 99-17416 for SEQ 801,
cagaccccaggatattag

SEQ ID NO: 4736 - DNA, 18 bp, Homo Sapiens
  primer_bind 1..18: upstream amplification primer 99-17418 for SEQ 802,
acagtttcctttgccttc

SEQ ID NO: 4737 - DNA, 20 bp, Homo Sapiens
  primer_bind 1..20: upstream amplification primer 99-17420 for SEQ 803,
cttgtttgagaggaagaatg

SEQ ID NO: 4738 - DNA, 19 bp, Homo Sapiens
  primer_bind 1..19: upstream amplification primer 99-17428 for SEQ 804,
gggaaaccattaacataac

SEQ ID NO: 4739 - DNA, 18 bp, Homo Sapiens
  primer_bind 1..18: upstream amplification primer 99-17450 for SEQ 805,
aactcctattctcccatc

SEQ ID NO: 4740 - DNA, 19 bp, Homo Sapiens
  primer_bind 1..19: upstream amplification primer 99-17464 for SEQ 806,
agtttaggagttcgttctg

SEQ ID NO: 4741 - DNA, 21 bp, Homo Sapiens
  primer_bind 1..21: upstream amplification primer 99-17476 for SEQ 807,
caggataccattttcaaaatc

SEQ ID NO: 4742 - DNA, 18 bp, Homo Sapiens
  primer_bind 1..18: upstream amplification primer 99-17481 for SEQ 808,
ctatattcccctcttcac

SEQ ID NO: 4743 - DNA, 18 bp, Homo Sapiens
  primer_bind 1..18: upstream amplification primer 99-17483 for SEQ 809,
ctctcttttttctccctc

SEQ ID NO: 4744 - DNA, 19 bp, Homo Sapiens
  primer_bind 1..19: upstream amplification primer 99-17490 for SEQ 810,
cataaagggcagaattgac

SEQ ID NO: 4745 - DNA, 19 bp, Homo Sapiens
  primer_bind 1..19: upstream amplification primer 99-17491 for SEQ 811,
tccctgaaataaaactacc

SEQ ID NO: 4746 - DNA, 19 bp, Homo Sapiens
  primer_bind 1..19: upstream amplification primer 99-17495 for SEQ 812,
tgacctatctggaggcaac

SEQ ID NO: 4747 - DNA, 19 bp, Homo Sapiens
  primer_bind 1..19: upstream amplification primer 99-17496 for SEQ 813,
atgtaacctaaactagacc

SEQ ID NO: 4748 - DNA, 21 bp, Homo Sapiens
  primer_bind 1..21: upstream amplification primer 99-17498 for SEQ 814,
caattcgttgtttaactttgg

SEQ ID NO: 4749 - DNA, 18 bp, Homo Sapiens
  primer_bind 1..18: upstream amplification primer 99-17499 for SEQ 815,
accacaaaacaaggagac

SEQ ID NO: 4750 - DNA, 19 bp, Homo Sapiens
  primer_bind 1..19: upstream amplification primer 99-17520 for SEQ 816,
catttctctccactaccac

SEQ ID NO: 4751 - DNA, 18 bp, Homo Sapiens
  primer_bind 1..18: upstream amplification primer 99-17522 for SEQ 817,
tgactacagcttactggg

SEQ ID NO: 4752 - DNA, 21 bp, Homo Sapiens
  primer_bind 1..21: upstream amplification primer 99-17523 for SEQ 818,
ccatataaataaaccttggtg

SEQ ID NO: 4753 - DNA, 19 bp, Homo Sapiens
  primer_bind 1..19: upstream amplification primer 99-17529 for SEQ 819,
atccactctcctcaacctc

SEQ ID NO: 4754 - DNA, 20 bp, Homo Sapiens
  primer_bind 1..20: upstream amplification primer 99-17557 for SEQ 820,
catctgtgcggaaagttatg

SEQ ID NO: 4755 - DNA, 20 bp, Homo Sapiens
  primer_bind 1..20: upstream amplification primer 99-17563 for SEQ 821,
ttccactgatttctctttcc

SEQ ID NO: 4756 - DNA, 19 bp, Homo Sapiens
  primer_bind 1..19: upstream amplification primer 99-17588 for SEQ 822,
caaatgccaagagagaaag

SEQ ID NO: 4757 - DNA, 19 bp, Homo Sapiens
  primer_bind 1..19: upstream amplification primer 99-17610 for SEQ 823,
aagccaccaacctgtgatg

SEQ ID NO: 4758 - DNA, 18 bp, Homo Sapiens
  primer_bind 1..18: upstream amplification primer 99-17629 for SEQ 824,
agttattggaggaagagg

SEQ ID NO: 4759 - DNA, 18 bp, Homo Sapiens
  primer_bind 1..18: upstream amplification primer 99-1764 for SEQ 825,
caggaggacatgaaaagg

SEQ ID NO: 4760 - DNA, 18 bp, Homo Sapiens
  primer_bind 1..18: upstream amplification primer 99-17647 for SEQ 826,
cagcatttgtagttaccc

SEQ ID NO: 4761 - DNA, 19 bp, Homo Sapiens
  primer_bind 1..19: upstream amplification primer 99-1765 for SEQ 827,
gaactcgtgaatagtattg

SEQ ID NO: 4762 - DNA, 18 bp, Homo Sapiens
  primer_bind 1..18: upstream amplification primer 99-17656 for SEQ 828,
aacgtgtggtctgaaatg

SEQ ID NO: 4763 - DNA, 19 bp, Homo Sapiens
  primer_bind 1..19: upstream amplification primer 99-17658 for SEQ 829,
attcactctgggcatcctc

SEQ ID NO: 4764 - DNA, 19 bp, Homo Sapiens
  primer_bind 1..19: upstream amplification primer 99-17662 for SEQ 830,
gctaacagttgttaatggg

SEQ ID NO: 4765 - DNA, 18 bp, Homo Sapiens
  primer_bind 1..18: upstream amplification primer 99-17663 for SEQ 831,
aagtcctgggttagactg

SEQ ID NO: 4766 - DNA, 18 bp, Homo Sapiens
  primer_bind 1..18: upstream amplification primer 99-17677 for SEQ 832,
catcacattacaccacac

SEQ ID NO: 4767 - DNA, 20 bp, Homo Sapiens
  primer_bind 1..20: upstream amplification primer 99-17680 for SEQ 833,
gccataaagatgaatggaag

SEQ ID NO: 4768 - DNA, 19 bp, Homo Sapiens
  primer_bind 1..19: upstream amplification primer 99-17683 for SEQ 834,
ctcctaaaatcagttcacg

SEQ ID NO: 4769 - DNA, 18 bp, Homo Sapiens
  primer_bind 1..18: upstream amplification primer 99-17687 for SEQ 835,
gcacacccctaaattccc

SEQ ID NO: 4770 - DNA, 20 bp, Homo Sapiens
  primer_bind 1..20: upstream amplification primer 99-17700 for SEQ 836,
gctaatatacttgttgtacc

SEQ ID NO: 4771 - DNA, 18 bp, Homo Sapiens
  primer_bind 1..18: upstream amplification primer 99-17702 for SEQ 837,
acaataagactgagcccc

SEQ ID NO: 4772 - DNA, 18 bp, Homo Sapiens
  primer_bind 1..18: upstream amplification primer 99-17718 for SEQ 838,
ctgacttactctggaagg

SEQ ID NO: 4773 - DNA, 18 bp, Homo Sapiens
  primer_bind 1..18: upstream amplification primer 99-17720 for SEQ 839,
atgccactatcacctacc

SEQ ID NO: 4774 - DNA, 19 bp, Homo Sapiens
  primer_bind 1..19: upstream amplification primer 99-17728 for SEQ 840,
tagttttgtttgggtaagg

SEQ ID NO: 4775 - DNA, 21 bp, Homo Sapiens
  primer_bind 1..21: upstream amplification primer 99-1773 for SEQ 841,
caactcagtctaataaaactc

SEQ ID NO: 4776 - DNA, 19 bp, Homo Sapiens
  primer_bind 1..19: upstream amplification primer 99-17740 for SEQ 842,
atgcctactttcttttctg

SEQ ID NO: 4777 - DNA, 20 bp, Homo Sapiens
  primer_bind 1..20: upstream amplification primer 99-1775 for SEQ 843,
cttttaagttgtcttcttgg

SEQ ID NO: 4778 - DNA, 19 bp, Homo Sapiens
  primer_bind 1..19: upstream amplification primer 99-17758 for SEQ 844,
atggaaaggacaaaaactc

SEQ ID NO: 4779 - DNA, 18 bp, Homo Sapiens
  primer_bind 1..18: upstream amplification primer 99-17762 for SEQ 845,
tgtgagaggtagagaagg

SEQ ID NO: 4780 - DNA, 19 bp, Homo Sapiens
  primer_bind 1..19: upstream amplification primer 99-17773 for SEQ 846,
cagataacagaaagtatcc

SEQ ID NO: 4781 - DNA, 19 bp, Homo Sapiens
  primer_bind 1..19: upstream amplification primer 99-17774 for SEQ 847,
gcaattttgaaaagtagcc

SEQ ID NO: 4782 - DNA, 18 bp, Homo Sapiens
  primer_bind 1..18: upstream amplification primer 99-17775 for SEQ 848,
ttggcatggaaaccagag

SEQ ID NO: 4783 - DNA, 18 bp, Homo Sapiens
  primer_bind 1..18: upstream amplification primer 99-17776 for SEQ 849,
gaaattccttccactgag

SEQ ID NO: 4784 - DNA, 19 bp, Homo Sapiens
  primer_bind 1..19: upstream amplification primer 99-17779 for SEQ 850,
tagttcattcctatgcttc

SEQ ID NO: 4785 - DNA, 21 bp, Homo Sapiens
  primer_bind 1..21: upstream amplification primer 99-17792 for SEQ 851,
gtaatttattcagaaggaggg

SEQ ID NO: 4786 - DNA, 19 bp, Homo Sapiens
  primer_bind 1..19: upstream amplification primer 99-17798 for SEQ 852,
gctcagaattaatccctcc

SEQ ID NO: 4787 - DNA, 18 bp, Homo Sapiens
  primer_bind 1..18: upstream amplification primer 99-17802 for SEQ 853,
accctttgtcatttcccc

SEQ ID NO: 4788 - DNA, 19 bp, Homo Sapiens
  primer_bind 1..19: upstream amplification primer 99-17808 for SEQ 854,
aaagctcagaggcagttgg

SEQ ID NO: 4789 - DNA, 20 bp, Homo Sapiens
  primer_bind 1..20: upstream amplification primer 99-1781 for SEQ 855,
cacaaaatactgacattgac

SEQ ID NO: 4790 - DNA, 19 bp, Homo Sapiens
  primer_bind 1..19: upstream amplification primer 99-17810 for SEQ 856,
tgtttcgttaaaggctatg

SEQ ID NO: 4791 - DNA, 19 bp, Homo Sapiens
  primer_bind 1..19: upstream amplification primer 99-17816 for SEQ 857,
cgttcttacttgacttgag

SEQ ID NO: 4792 - DNA, 18 bp, Homo Sapiens
  primer_bind 1..18: upstream amplification primer 99-17820 for SEQ 858,
cccccacattatcttcac

SEQ ID NO: 4793 - DNA, 20 bp, Homo Sapiens
  primer_bind 1..20: upstream amplification primer 99-17821 for SEQ 859,
actgtgctcttgagtcgctg

SEQ ID NO: 4794 - DNA, 18 bp, Homo Sapiens
  primer_bind 1..18: upstream amplification primer 99-17827 for SEQ 860,
tgtcttttcccagtgttc

SEQ ID NO: 4795 - DNA, 19 bp, Homo Sapiens
  primer_bind 1..19: upstream amplification primer 99-17829 for SEQ 861,
tttgacatgatatgtgacc

SEQ ID NO: 4796 - DNA, 18 bp, Homo Sapiens
  primer_bind 1..18: upstream amplification primer 99-17833 for SEQ 862,
aggaattaggagaagtgg

SEQ ID NO: 4797 - DNA, 20 bp, Homo Sapiens
  primer_bind 1..20: upstream amplification primer 99-17845 for SEQ 863,
catagtaaagtggctacagg

SEQ ID NO: 4798 - DNA, 21 bp, Homo Sapiens
  primer_bind 1..21: upstream amplification primer 99-17854 for SEQ 864,
ctctcgtgatttctttttggg

SEQ ID NO: 4799 - DNA, 18 bp, Homo Sapiens
  primer_bind 1..18: upstream amplification primer 99-17856 for SEQ 865,
cactaaatcttgacaggg

SEQ ID NO: 4800 - DNA, 18 bp, Homo Sapiens
  primer_bind 1..18: upstream amplification primer 99-17857 for SEQ 866,
ctcctcataggatctctc

SEQ ID NO: 4801 - DNA, 18 bp, Homo Sapiens
  primer_bind 1..18: upstream amplification primer 99-17863 for SEQ 867,
caagctctgttctgggtc

SEQ ID NO: 4802 - DNA, 18 bp, Homo Sapiens
  primer_bind 1..18: upstream amplification primer 99-17864 for SEQ 868,
tctctccctgtcttatcc

SEQ ID NO: 4803 - DNA, 19 bp, Homo Sapiens
  primer_bind 1..19: upstream amplification primer 99-17866 for SEQ 869,
gttatatgggttcaatagg

SEQ ID NO: 4804 - DNA, 18 bp, Homo Sapiens
  primer_bind 1..18: upstream amplification primer 99-17889 for SEQ 870,
taaaatgggcatcagagg

SEQ ID NO: 4805 - DNA, 18 bp, Homo Sapiens
  primer_bind 1..18: upstream amplification primer 99-17890 for SEQ 871,
ttcttgtagtgttgctgg

SEQ ID NO: 4806 - DNA, 19 bp, Homo Sapiens
  primer_bind 1..19: upstream amplification primer 99-17899 for SEQ 872,
ggctctaacaaaagaaaac

SEQ ID NO: 4807 - DNA, 19 bp, Homo Sapiens
  primer_bind 1..19: upstream amplification primer 99-17913 for SEQ 873,
gagggtcacatccaatcag

SEQ ID NO: 4808 - DNA, 18 bp, Homo Sapiens
  primer_bind 1..18: upstream amplification primer 99-17920 for SEQ 874,
aatactttgcccacaccc

SEQ ID NO: 4809 - DNA, 19 bp, Homo Sapiens
  primer_bind 1..19: upstream amplification primer 99-1793 for SEQ 875,
ggctggaactatgaagttg

SEQ ID NO: 4810 - DNA, 18 bp, Homo Sapiens
  primer_bind 1..18: upstream amplification primer 99-17938 for SEQ 876,
ccttctccattcatacac

SEQ ID NO: 4811 - DNA, 19 bp, Homo Sapiens
  primer_bind 1..19: upstream amplification primer 99-17945 for SEQ 877,
caccataaattgtgaagag

SEQ ID NO: 4812 - DNA, 18 bp, Homo Sapiens
  primer_bind 1..18: upstream amplification primer 99-17946 for SEQ 878,
tttctaggatgtcggagg

SEQ ID NO: 4813 - DNA, 19 bp, Homo Sapiens
  primer_bind 1..19: upstream amplification primer 99-17952 for SEQ 879,
agtgtaggtgaatgatatg

SEQ ID NO: 4814 - DNA, 19 bp, Homo Sapiens
  primer_bind 1..19: upstream amplification primer 99-1796 for SEQ 880,
acataccacactttgattc

SEQ ID NO: 4815 - DNA, 20 bp, Homo Sapiens
  primer_bind 1..20: upstream amplification primer 99-17971 for SEQ 881,
ctttgccagtttgtaacacc

SEQ ID NO: 4816 - DNA, 20 bp, Homo Sapiens
  primer_bind 1..20: upstream amplification primer 99-17976 for SEQ 882,
tgcttcctctccaaccttcc

SEQ ID NO: 4817 - DNA, 19 bp, Homo Sapiens
  primer_bind 1..19: upstream amplification primer 99-17989 for SEQ 883,
cagatgactacatacacac

SEQ ID NO: 4818 - DNA, 18 bp, Homo Sapiens
  primer_bind 1..18: upstream amplification primer 99-17991 for SEQ 884,
ctcataaagaagactgcc

SEQ ID NO: 4819 - DNA, 20 bp, Homo Sapiens
  primer_bind 1..20: upstream amplification primer 99-17992 for SEQ 885,
gtgtagtcaagcatattaag

SEQ ID NO: 4820 - DNA, 18 bp, Homo Sapiens
  primer_bind 1..18: upstream amplification primer 99-18004 for SEQ 886,
caccaacttccatctaac

SEQ ID NO: 4821 - DNA, 18 bp, Homo Sapiens
  primer_bind 1..18: upstream amplification primer 99-18007 for SEQ 887,
gcacccagtttatgcaag

SEQ ID NO: 4822 - DNA, 20 bp, Homo Sapiens
  primer_bind 1..20: upstream amplification primer 99-18030 for SEQ 888,
tcaagaccacagaagaaaag

SEQ ID NO: 4823 - DNA, 20 bp, Homo Sapiens
  primer_bind 1..20: upstream amplification primer 99-18038 for SEQ 889,
agagcacccatcttccatcc

SEQ ID NO: 4824 - DNA, 20 bp, Homo Sapiens
  primer_bind 1..20: upstream amplification primer 99-18046 for SEQ 890,
gttatatatgtgtgtgtgtg

SEQ ID NO: 4825 - DNA, 18 bp, Homo Sapiens
  primer_bind 1..18: upstream amplification primer 99-18053 for SEQ 891,
gagaggctgggatttaac

SEQ ID NO: 4826 - DNA, 19 bp, Homo Sapiens
  primer_bind 1..19: upstream amplification primer 99-18054 for SEQ 892,
agccaccagttttgttccc

SEQ ID NO: 4827 - DNA, 18 bp, Homo Sapiens
  primer_bind 1..18: upstream amplification primer 99-18056 for SEQ 893,
tctatcctcttctcccac

SEQ ID NO: 4828 - DNA, 18 bp, Homo Sapiens
  primer_bind 1..18: upstream amplification primer 99-18057 for SEQ 894,
acagggaaaggaaatcac

SEQ ID NO: 4829 - DNA, 18 bp, Homo Sapiens
  primer_bind 1..18: upstream amplification primer 99-18060 for SEQ 895,
ctctttgaatctgctagg

SEQ ID NO: 4830 - DNA, 18 bp, Homo Sapiens
  primer_bind 1..18: upstream amplification primer 99-18062 for SEQ 896,
gtttgccttgaatctggg

SEQ ID NO: 4831 - DNA, 18 bp, Homo Sapiens
  primer_bind 1..18: upstream amplification primer 99-18069 for SEQ 897,
ctcctatcttctcccttc

SEQ ID NO: 4832 - DNA, 19 bp, Homo Sapiens
  primer_bind 1..19: upstream amplification primer 99-18079 for SEQ 898,
gaaattgaaggggaaaatg

SEQ ID NO: 4833 - DNA, 18 bp, Homo Sapiens
  primer_bind 1..18: upstream amplification primer 99-1808 for SEQ 899,
cacacttgctcaaaactg

SEQ ID NO: 4834 - DNA, 19 bp, Homo Sapiens
  primer_bind 1..19: upstream amplification primer 99-18080 for SEQ 900,
cttaatccaaactacactc

SEQ ID NO: 4835 - DNA, 21 bp, Homo Sapiens
  primer_bind 1..21: upstream amplification primer 99-18085 for SEQ 901,
gttattgatttgacagagttc

SEQ ID NO: 4836 - DNA, 20 bp, Homo Sapiens
  primer_bind 1..20: upstream amplification primer 99-18086 for SEQ 902,
gtcccaactcaaaataaatc

SEQ ID NO: 4837 - DNA, 20 bp, Homo Sapiens
  primer_bind 1..20: upstream amplification primer 99-18087 for SEQ 903,
cctatgaaaaactgtagcac

SEQ ID NO: 4838 - DNA, 20 bp, Homo Sapiens
  primer_bind 1..20: upstream amplification primer 99-18091 for SEQ 904,
gatgagaaagagtagatgcc

SEQ ID NO: 4839 - DNA, 18 bp, Homo Sapiens
  primer_bind 1..18: upstream amplification primer 99-18096 for SEQ 905,
aggcagagttccctattc

SEQ ID NO: 4840 - DNA, 18 bp, Homo Sapiens
  primer_bind 1..18: upstream amplification primer 99-18109 for SEQ 906,
ttttaggaggtggaagac

SEQ ID NO: 4841 - DNA, 20 bp, Homo Sapiens
  primer_bind 1..20: upstream amplification primer 99-1813 for SEQ 907,
gcttgggagcaaataacatc

SEQ ID NO: 4842 - DNA, 18 bp, Homo Sapiens
  primer_bind 1..18: upstream amplification primer 99-18130 for SEQ 908,
agccacgaagcaaaacac

SEQ ID NO: 4843 - DNA, 19 bp, Homo Sapiens
  primer_bind 1..19: upstream amplification primer 99-1814 for SEQ 909,
caatccagagacagaaaag

SEQ ID NO: 4844 - DNA, 18 bp, Homo Sapiens
  primer_bind 1..18: upstream amplification primer 99-18171 for SEQ 910,
tttgaaatggttgagggg

SEQ ID NO: 4845 - DNA, 18 bp, Homo Sapiens
  primer_bind 1..18: upstream amplification primer 99-18172 for SEQ 911,
ttcaagaatccctggctg

SEQ ID NO: 4846 - DNA, 19 bp, Homo Sapiens
  primer_bind 1..19: upstream amplification primer 99-18179 for SEQ 912,
tacttcatttcctttctcc

SEQ ID NO: 4847 - DNA, 19 bp, Homo Sapiens
  primer_bind 1..19: upstream amplification primer 99-18198 for SEQ 913,
aacttagaactgctttgac

SEQ ID NO: 4848 - DNA, 19 bp, Homo Sapiens
  primer_bind 1..19: upstream amplification primer 99-18201 for SEQ 914,
caaatgacaatgcttgttc

SEQ ID NO: 4849 - DNA, 19 bp, Homo Sapiens
  primer_bind 1..19: upstream amplification primer 99-18206 for SEQ 915,
ttgtaagtgaatgtcacag

SEQ ID NO: 4850 - DNA, 19 bp, Homo Sapiens
  primer_bind 1..19: upstream amplification primer 99-18210 for SEQ 916,
atgctattgttctcttcac

SEQ ID NO: 4851 - DNA, 19 bp, Homo Sapiens
  primer_bind 1..19: upstream amplification primer 99-18213 for SEQ 917,
ctccccattctaaaccaac

SEQ ID NO: 4852 - DNA, 18 bp, Homo Sapiens
  primer_bind 1..18: upstream amplification primer 99-18214 for SEQ 918,
ctggcactctgtcgtctc

SEQ ID NO: 4853 - DNA, 19 bp, Homo Sapiens
  primer_bind 1..19: upstream amplification primer 99-18221 for SEQ 919,
tggagtcatcccagtacag

SEQ ID NO: 4854 - DNA, 20 bp, Homo Sapiens
  primer_bind 1..20: upstream amplification primer 99-1823 for SEQ 920,
gtccaatttttttctctctc

SEQ ID NO: 4855 - DNA, 21 bp, Homo Sapiens
  primer_bind 1..21: upstream amplification primer 99-1824 for SEQ 921,
tgaggtagcctctgaaaactg

SEQ ID NO: 4856 - DNA, 18 bp, Homo Sapiens
  primer_bind 1..18: upstream amplification primer 99-18242 for SEQ 922,
tgataggcacaagtaagg

SEQ ID NO: 4857 - DNA, 18 bp, Homo Sapiens
  primer_bind 1..18: upstream amplification primer 99-18253 for SEQ 923,
tctccattctttcctctc

SEQ ID NO: 4858 - DNA, 19 bp, Homo Sapiens
  primer_bind 1..19: upstream amplification primer 99-18255 for SEQ 924,
acagcctaataactactac

SEQ ID NO: 4859 - DNA, 19 bp, Homo Sapiens
  primer_bind 1..19: upstream amplification primer 99-18258 for SEQ 925,
aaaaggggctcagagacag

SEQ ID NO: 4860 - DNA, 20 bp, Homo Sapiens
  primer_bind 1..20: upstream amplification primer 99-18268 for SEQ 926,
gaagtacggatagaacatag

SEQ ID NO: 4861 - DNA, 18 bp, Homo Sapiens
  primer_bind 1..18: upstream amplification primer 99-18272 for SEQ 927,
acacaaagaaagcagtcc

SEQ ID NO: 4862 - DNA, 19 bp, Homo Sapiens
  primer_bind 1..19: upstream amplification primer 99-18276 for SEQ 928,
ctgtttgtcatttcctgtc

SEQ ID NO: 4863 - DNA, 18 bp, Homo Sapiens
  primer_bind 1..18: upstream amplification primer 99-18288 for SEQ 929,
aagagtgaggagagaatg

SEQ ID NO: 4864 - DNA, 19 bp, Homo Sapiens
  primer_bind 1..19: upstream amplification primer 99-18289 for SEQ 930,
aagtatatgcacagatgag

SEQ ID NO: 4865 - DNA, 19 bp, Homo Sapiens
  primer_bind 1..19: upstream amplification primer 99-18303 for SEQ 931,
aatcttccttcgcccactc

SEQ ID NO: 4866 - DNA, 19 bp, Homo Sapiens
  primer_bind 1..19: upstream amplification primer 99-18306 for SEQ 932,
actcttccatctctccctc

SEQ ID NO: 4867 - DNA, 18 bp, Homo Sapiens
  primer_bind 1..18: upstream amplification primer 99-18307 for SEQ 933,
agtgggggaaatagaagg

SEQ ID NO: 4868 - DNA, 20 bp, Homo Sapiens
  primer_bind 1..20: upstream amplification primer 99-18310 for SEQ 934,
ggtaataggatggaatatgg

SEQ ID NO: 4869 - DNA, 19 bp, Homo Sapiens
  primer_bind 1..19: upstream amplification primer 99-18312 for SEQ 935,
tgtctttaagttgttcagc

SEQ ID NO: 4870 - DNA, 18 bp, Homo Sapiens
  primer_bind 1..18: upstream amplification primer 99-18341 for SEQ 936,
tttgaaatggttgagggg

SEQ ID NO: 4871 - DNA, 18 bp, Homo Sapiens
  primer_bind 1..18: upstream amplification primer 99-18344 for SEQ 937,
ttcaagaatccctggctg

SEQ ID NO: 4872 - DNA, 19 bp, Homo Sapiens
  primer_bind 1..19: upstream amplification primer 99-18345 for SEQ 938,
cagaaagctgtttgaatgg

SEQ ID NO: 4873 - DNA, 19 bp, Homo Sapiens
  primer_bind 1..19: upstream amplification primer 99-18371 for SEQ 939,
agaaatcattgggtaagag

SEQ ID NO: 4874 - DNA, 19 bp, Homo Sapiens
  primer_bind 1..19: upstream amplification primer 99-18373 for SEQ 940,
agttatagcttatgagcac

SEQ ID NO: 4875 - DNA, 21 bp, Homo Sapiens
  primer_bind 1..21: upstream amplification primer 99-18375 for SEQ 941,
gtgttaaaaagagaatgtagg

SEQ ID NO: 4876 - DNA, 19 bp, Homo Sapiens
  primer_bind 1..19: upstream amplification primer 99-18379 for SEQ 942,
actgatttctagtattgcc

SEQ ID NO: 4877 - DNA, 18 bp, Homo Sapiens
  primer_bind 1..18: upstream amplification primer 99-18386 for SEQ 943,
tggaggtggaggtaaaag

SEQ ID NO: 4878 - DNA, 18 bp, Homo Sapiens
  primer_bind 1..18: upstream amplification primer 99-18394 for SEQ 944,
cttgaacttgagctgctg

SEQ ID NO: 4879 - DNA, 18 bp, Homo Sapiens
  primer_bind 1..18: upstream amplification primer 99-18402 for SEQ 945,
cctctttgccctaatcac

SEQ ID NO: 4880 - DNA, 19 bp, Homo Sapiens
  primer_bind 1..19: upstream amplification primer 99-18406 for SEQ 946,
actggtttcctagcccttg

SEQ ID NO: 4881 - DNA, 19 bp, Homo Sapiens
  primer_bind 1..19: upstream amplification primer 99-18414 for SEQ 947,
cggctattttaaatccctc

SEQ ID NO: 4882 - DNA, 19 bp, Homo Sapiens
  primer_bind 1..19: upstream amplification primer 99-18418 for SEQ 948,
aagtaccttcctaccctcc

SEQ ID NO: 4883 - DNA, 19 bp, Homo Sapiens
  primer_bind 1..19: upstream amplification primer 99-1842 for SEQ 949,
aggttcataagtttctctc

SEQ ID NO: 4884 - DNA, 18 bp, Homo Sapiens
  primer_bind 1..18: upstream amplification primer 99-18423 for SEQ 950,
attatggaggctttgctg

SEQ ID NO: 4885 - DNA, 18 bp, Homo Sapiens
  primer_bind 1..18: upstream amplification primer 99-18427 for SEQ 951,
tctacacttcctattgcc

SEQ ID NO: 4886 - DNA, 18 bp, Homo Sapiens
  primer_bind 1..18: upstream amplification primer 99-18438 for SEQ 952,
ttttacccactgcttgtc

SEQ ID NO: 4887 - DNA, 21 bp, Homo Sapiens
  primer_bind 1..21: upstream amplification primer 99-18442 for SEQ 953,
ctgacaccaaataaaatgaag

SEQ ID NO: 4888 - DNA, 19 bp, Homo Sapiens
  primer_bind 1..19: upstream amplification primer 99-18444 for SEQ 954,
ggtatgtattgggttgttg

SEQ ID NO: 4889 - DNA, 20 bp, Homo Sapiens
  primer_bind 1..20: upstream amplification primer 99-18458 for SEQ 955,
ctcaactaatgtaatcaggg

SEQ ID NO: 4890 - DNA, 19 bp, Homo Sapiens
  primer_bind 1..19: upstream amplification primer 99-18470 for SEQ 956,
gttctgtcttgtatggttg

SEQ ID NO: 4891 - DNA, 20 bp, Homo Sapiens
  primer_bind 1..20: upstream amplification primer 99-18478 for SEQ 957,
accaaacttgtggtcttatc

SEQ ID NO: 4892 - DNA, 19 bp, Homo Sapiens
  primer_bind 1..19: upstream amplification primer 99-18486 for SEQ 958,
cttcagagtagcaagaacc

SEQ ID NO: 4893 - DNA, 20 bp, Homo Sapiens
  primer_bind 1..20: upstream amplification primer 99-18487 for SEQ 959,
caagaacctactttttaacc

SEQ ID NO: 4894 - DNA, 19 bp, Homo Sapiens
  primer_bind 1..19: upstream amplification primer 99-18488 for SEQ 960,
tccacattctttctacttc

SEQ ID NO: 4895 - DNA, 19 bp, Homo Sapiens
  primer_bind 1..19: upstream amplification primer 99-1849 for SEQ 961,
gaagatgtatgtctaagag

SEQ ID NO: 4896 - DNA, 20 bp, Homo Sapiens
  primer_bind 1..20: upstream amplification primer 99-18536 for SEQ 962,
gtgtcttttctttttcatcc

SEQ ID NO: 4897 - DNA, 19 bp, Homo Sapiens
  primer_bind 1..19: upstream amplification primer 99-18542 for SEQ 963,
gaggtgaattactgattgg

SEQ ID NO: 4898 - DNA, 18 bp, Homo Sapiens
  primer_bind 1..18: upstream amplification primer 99-18551 for SEQ 964,
catgcaatgccatgtgtc

SEQ ID NO: 4899 - DNA, 18 bp, Homo Sapiens
  primer_bind 1..18: upstream amplification primer 99-18561 for SEQ 965,
caaccttccttgggaaac

SEQ ID NO: 4900 - DNA, 18 bp, Homo Sapiens
  primer_bind 1..18: upstream amplification primer 99-18573 for SEQ 966,
ctccacttccacagttag

SEQ ID NO: 4901 - DNA, 18 bp, Homo Sapiens
  primer_bind 1..18: upstream amplification primer 99-18582 for SEQ 967,
agttaaacggaggcacag

SEQ ID NO: 4902 - DNA, 20 bp, Homo Sapiens
  primer_bind 1..20: upstream amplification primer 99-18588 for SEQ 968,
ctatttcacccaccacactc

SEQ ID NO: 4903 - DNA, 18 bp, Homo Sapiens
  primer_bind 1..18: upstream amplification primer 99-18596 for SEQ 969,
gaagattgtttgaagggg

SEQ ID NO: 4904 - DNA, 19 bp, Homo Sapiens
  primer_bind 1..19: upstream amplification primer 99-18597 for SEQ 970,
caagagtgagagtatctgg

SEQ ID NO: 4905 - DNA, 18 bp, Homo Sapiens
  primer_bind 1..18: upstream amplification primer 99-18599 for SEQ 971,
tgtcccatgcacaaactc

SEQ ID NO: 4906 - DNA, 19 bp, Homo Sapiens
  primer_bind 1..19: upstream amplification primer 99-1860 for SEQ 972,
ctgtagtattttgtcatgg

SEQ ID NO: 4907 - DNA, 18 bp, Homo Sapiens
  primer_bind 1..18: upstream amplification primer 99-18602 for SEQ 973,
ggctgtgctaaagtgttg

SEQ ID NO: 4908 - DNA, 19 bp, Homo Sapiens
  primer_bind 1..19: upstream amplification primer 99-18606 for SEQ 974,
aaactacccagccagcttg

SEQ ID NO: 4909 - DNA, 19 bp, Homo Sapiens
  primer_bind 1..19: upstream amplification primer 99-1861 for SEQ 975,
ccaacagaagacatgattc

SEQ ID NO: 4910 - DNA, 18 bp, Homo Sapiens
  primer_bind 1..18: upstream amplification primer 99-18612 for SEQ 976,
ctcttgttcttcctctcc

SEQ ID NO: 4911 - DNA, 21 bp, Homo Sapiens
  primer_bind 1..21: upstream amplification primer 99-18618 for SEQ 977,
gaggaaatgtaaaataaaggg

SEQ ID NO: 4912 - DNA, 18 bp, Homo Sapiens
  primer_bind 1..18: upstream amplification primer 99-18620 for SEQ 978,
ccacaggatgtcattcag

SEQ ID NO: 4913 - DNA, 20 bp, Homo Sapiens
  primer_bind 1..20: upstream amplification primer 99-18637 for SEQ 979,
cgattcccatctgagcagac

SEQ ID NO: 4914 - DNA, 19 bp, Homo Sapiens
  primer_bind 1..19: upstream amplification primer 99-18638 for SEQ 980,
aatgtttctaggcagtttc

SEQ ID NO: 4915 - DNA, 21 bp, Homo Sapiens
  primer_bind 1..21: upstream amplification primer 99-18640 for SEQ 981,
ggttacttcactgcatttagg

SEQ ID NO: 4916 - DNA, 18 bp, Homo Sapiens
  primer_bind 1..18: upstream amplification primer 99-18648 for SEQ 982,
ttcctttccatttagccc

SEQ ID NO: 4917 - DNA, 19 bp, Homo Sapiens
  primer_bind 1..19: upstream amplification primer 99-18666 for SEQ 983,
gaacatttgaggcagacac

SEQ ID NO: 4918 - DNA, 20 bp, Homo Sapiens
  primer_bind 1..20: upstream amplification primer 99-18667 for SEQ 984,
agcagaaaagaatgtcaagc

SEQ ID NO: 4919 - DNA, 19 bp, Homo Sapiens
  primer_bind 1..19: upstream amplification primer 99-18669 for SEQ 985,
gtgtcaaatgaggagttac

SEQ ID NO: 4920 - DNA, 18 bp, Homo Sapiens
  primer_bind 1..18: upstream amplification primer 99-18715 for SEQ 986,
ctgctgtcatagatgtgg

SEQ ID NO: 4921 - DNA, 20 bp, Homo Sapiens
  primer_bind 1..20: upstream amplification primer 99-18719 for SEQ 987,
tgtccccctaaaatgacttg

SEQ ID NO: 4922 - DNA, 19 bp, Homo Sapiens
  primer_bind 1..19: upstream amplification primer 99-18720 for SEQ 988,
aaggaaaattagtatgggg

SEQ ID NO: 4923 - DNA, 19 bp, Homo Sapiens
  primer_bind 1..19: upstream amplification primer 99-18721 for SEQ 989,
ccagataacttttgagaac

SEQ ID NO: 4924 - DNA, 19 bp, Homo Sapiens
  primer_bind 1..19: upstream amplification primer 99-18724 for SEQ 990,
accttgggtttgctgcatc

SEQ ID NO: 4925 - DNA, 20 bp, Homo Sapiens
  primer_bind 1..20: upstream amplification primer 99-18729 for SEQ 991,
agtgctgtaataaggggctg

SEQ ID NO: 4926 - DNA, 19 bp, Homo Sapiens
  primer_bind 1..19: upstream amplification primer 99-1873 for SEQ 992,
ttgcttatttggttgctgg

SEQ ID NO: 4927 - DNA, 19 bp, Homo Sapiens
  primer_bind 1..19: upstream amplification primer 99-18744 for SEQ 993,
gacgcaagtttgtgtttac

SEQ ID NO: 4928 - DNA, 18 bp, Homo Sapiens
  primer_bind 1..18: upstream amplification primer 99-18745 for SEQ 994,
tgttccccttgccctgtg

SEQ ID NO: 4929 - DNA, 18 bp, Homo Sapiens
  primer_bind 1..18: upstream amplification primer 99-18747 for SEQ 995,
tctcaaagtgacagtggg

SEQ ID NO: 4930 - DNA, 21 bp, Homo Sapiens
  primer_bind 1..21: upstream amplification primer 99-18751 for SEQ 996,
gaaggaatagaattttcacac

SEQ ID NO: 4931 - DNA, 21 bp, Homo Sapiens
  primer_bind 1..21: upstream amplification primer 99-18755 for SEQ 997,
gatttctcaagtaagcatatc

SEQ ID NO: 4932 - DNA, 19 bp, Homo Sapiens
  primer_bind 1..19: upstream amplification primer 99-18774 for SEQ 998,
agagggtactgtgtgaagg

SEQ ID NO: 4933 - DNA, 19 bp, Homo Sapiens
  primer_bind 1..19: upstream amplification primer 99-18775 for SEQ 999,
gcagacctttcaaatatcc

SEQ ID NO: 4934 - DNA, 18 bp, Homo Sapiens
  primer_bind 1..18: upstream amplification primer 99-18777 for SEQ 1000,
cccactacataacactac

SEQ ID NO: 4935 - DNA, 18 bp, Homo Sapiens
  primer_bind 1..18: upstream amplification primer 99-18802 for SEQ 1001,
agacaccccacgatgcac

SEQ ID NO: 4936 - DNA, 19 bp, Homo Sapiens
  primer_bind 1..19: upstream amplification primer 99-18808 for SEQ 1002,
gtatctgcttgtaaatgtg

SEQ ID NO: 4937 - DNA, 18 bp, Homo Sapiens
  primer_bind 1..18: upstream amplification primer 99-18814 for SEQ 1003,
tgagttaaactgccagcc

SEQ ID NO: 4938 - DNA, 20 bp, Homo Sapiens
  primer_bind 1..20: upstream amplification primer 99-1882 for SEQ 1004,
atgaattgggggcatgaggg

SEQ ID NO: 4939 - DNA, 20 bp, Homo Sapiens
  primer_bind 1..20: upstream amplification primer 99-18822 for SEQ 1005,
taagtagtttggttctcagg

SEQ ID NO: 4940 - DNA, 19 bp, Homo Sapiens
  primer_bind 1..19: upstream amplification primer 99-18826 for SEQ 1006,
tgtatctacttcatttggg

SEQ ID NO: 4941 - DNA, 19 bp, Homo Sapiens
  primer_bind 1..19: upstream amplification primer 99-18827 for SEQ 1007,
aaggtaggtgggaggaaag

SEQ ID NO: 4942 - DNA, 19 bp, Homo Sapiens
  primer_bind 1..19: upstream amplification primer 99-1883 for SEQ 1008,
aatggtgagcacaaaaatc

SEQ ID NO: 4943 - DNA, 19 bp, Homo Sapiens
  primer_bind 1..19: upstream amplification primer 99-18847 for SEQ 1009,
atcataaatcccagagtag

SEQ ID NO: 4944 - DNA, 20 bp, Homo Sapiens
  primer_bind 1..20: upstream amplification primer 99-18853 for SEQ 1010,
cctatgccataaaagtctcc

SEQ ID NO: 4945 - DNA, 18 bp, Homo Sapiens
  primer_bind 1..18: upstream amplification primer 99-18855 for SEQ 1011,
catttccagtaccctgtc

SEQ ID NO: 4946 - DNA, 18 bp, Homo Sapiens
  primer_bind 1..18: upstream amplification primer 99-18860 for SEQ 1012,
gttacccttcatcacttc

SEQ ID NO: 4947 - DNA, 18 bp, Homo Sapiens
  primer_bind 1..18: upstream amplification primer 99-18861 for SEQ 1013,
aaatagcaacgtcccctc

SEQ ID NO: 4948 - DNA, 18 bp, Homo Sapiens
  primer_bind 1..18: upstream amplification primer 99-1888 for SEQ 1014,
gcaaaccaggtcatatac

SEQ ID NO: 4949 - DNA, 21 bp, Homo Sapiens
  primer_bind 1..21: upstream amplification primer 99-1890 for SEQ 1015,
ccaatgacaatatgactaaac

SEQ ID NO: 4950 - DNA, 19 bp, Homo Sapiens
  primer_bind 1..19: upstream amplification primer 99-1895 for SEQ 1016,
ttattttgtggtctcagtc

SEQ ID NO: 4951 - DNA, 19 bp, Homo Sapiens
  primer_bind 1..19: upstream amplification primer 99-18974 for SEQ 1017,
tgaaaaacatacaagaccc

SEQ ID NO: 4952 - DNA, 21 bp, Homo Sapiens
  primer_bind 1..21: upstream amplification primer 99-18976 for SEQ 1018,
atctcttgtaatttagccttc

SEQ ID NO: 4953 - DNA, 19 bp, Homo Sapiens
  primer_bind 1..19: upstream amplification primer 99-18982 for SEQ 1019,
taaattgccagggcagctc

SEQ ID NO: 4954 - DNA, 18 bp, Homo Sapiens
  primer_bind 1..18: upstream amplification primer 99-18986 for SEQ 1020,
aatactcattgagcaccc

SEQ ID NO: 4955 - DNA, 21 bp, Homo Sapiens
  primer_bind 1..21: upstream amplification primer 99-18987 for SEQ 1021,
cctcagatccatcccagaatc

SEQ ID NO: 4956 - DNA, 18 bp, Homo Sapiens
  primer_bind 1..18: upstream amplification primer 99-18995 for SEQ 1022,
catgaaaggctaagtgtc

SEQ ID NO: 4957 - DNA, 19 bp, Homo Sapiens
  primer_bind 1..19: upstream amplification primer 99-18996 for SEQ 1023,
cacaattcctcacaaatac

SEQ ID NO: 4958 - DNA, 19 bp, Homo Sapiens
  primer_bind 1..19: upstream amplification primer 99-19008 for SEQ 1024,
tccttgagggaagaccttg

SEQ ID NO: 4959 - DNA, 18 bp, Homo Sapiens
  primer_bind 1..18: upstream amplification primer 99-19013 for SEQ 1025,
agaagagatgagagggag

SEQ ID NO: 4960 - DNA, 18 bp, Homo Sapiens
  primer_bind 1..18: upstream amplification primer 99-19016 for SEQ 1026,
catcatggggtcagtcac

SEQ ID NO: 4961 - DNA, 19 bp, Homo Sapiens
  primer_bind 1..19: upstream amplification primer 99-1909 for SEQ 1027,
gagaagttcatactccttg

SEQ ID NO: 4962 - DNA, 19 bp, Homo Sapiens
  primer_bind 1..19: upstream amplification primer 99-1910 for SEQ 1028,
atgaactaagctacatacc

SEQ ID NO: 4963 - DNA, 21 bp, Homo Sapiens
  primer_bind 1..21: upstream amplification primer 99-1916 for SEQ 1029,
tggtaaagaggttatgttatg

SEQ ID NO: 4964 - DNA, 19 bp, Homo Sapiens
  primer_bind 1..19: upstream amplification primer 99-1917 for SEQ 1030,
gagtgatagtttggtagag

SEQ ID NO: 4965 - DNA, 19 bp, Homo Sapiens
  primer_bind 1..19: upstream amplification primer 99-19253 for SEQ 1031,
actataaagttccccattg

SEQ ID NO: 4966 - DNA, 19 bp, Homo Sapiens
  primer_bind 1..19: upstream amplification primer 99-19256 for SEQ 1032,
catttcaggacttgttgtg

SEQ ID NO: 4967 - DNA, 20 bp, Homo Sapiens
  primer_bind 1..20: upstream amplification primer 99-1934 for SEQ 1033,
gagtcatctgattatgtaac

SEQ ID NO: 4968 - DNA, 19 bp, Homo Sapiens
  primer_bind 1..19: upstream amplification primer 99-1936 for SEQ 1034,
catagatgtatctcacaac

SEQ ID NO: 4969 - DNA, 19 bp, Homo Sapiens
  primer_bind 1..19: upstream amplification primer 99-1944 for SEQ 1035,
ttttactgtttctcagctc

SEQ ID NO: 4970 - DNA, 18 bp, Homo Sapiens
  primer_bind 1..18: upstream amplification primer 99-1947 for SEQ 1036,
gcaacacacaagcaatgg

SEQ ID NO: 4971 - DNA, 19 bp, Homo Sapiens
  primer_bind 1..19: upstream amplification primer 99-1948 for SEQ 1037,
agtcttcatttcatcaagg

SEQ ID NO: 4972 - DNA, 19 bp, Homo Sapiens
  primer_bind 1..19: upstream amplification primer 99-1953 for SEQ 1038,
acaagtctttatgtggttc

SEQ ID NO: 4973 - DNA, 19 bp, Homo Sapiens
  primer_bind 1..19: upstream amplification primer 99-1955 for SEQ 1039,
taaaagcccagagaaatac

SEQ ID NO: 4974 - DNA, 19 bp, Homo Sapiens
  primer_bind 1..19: upstream amplification primer 99-1960 for SEQ 1040,
aaaggctttaatggtgttc

SEQ ID NO: 4975 - DNA, 20 bp, Homo Sapiens
  primer_bind 1..20: upstream amplification primer 99-1964 for SEQ 1041,
ctttctgacgaatccaatac

SEQ ID NO: 4976 - DNA, 19 bp, Homo Sapiens
  primer_bind 1..19: upstream amplification primer 99-1977 for SEQ 1042,
ctttctactcctttaggac

SEQ ID NO: 4977 - DNA, 18 bp, Homo Sapiens
  primer_bind 1..18: upstream amplification primer 99-1997 for SEQ 1043,
tgtgttgggttgtctgtc

SEQ ID NO: 4978 - DNA, 19 bp, Homo Sapiens
  primer_bind 1..19: upstream amplification primer 99-19999 for SEQ 1044,
aaacaaagaactagctgac

SEQ ID NO: 4979 - DNA, 18 bp, Homo Sapiens
  primer_bind 1..18: upstream amplification primer 99-2000 for SEQ 1045,
cacaatatctcacgtacc

SEQ ID NO: 4980 - DNA, 19 bp, Homo Sapiens
  primer_bind 1..19: upstream amplification primer 99-20000 for SEQ 1046,
aagcaagtgatagatactc

SEQ ID NO: 4981 - DNA, 21 bp, Homo Sapiens
  primer_bind 1..21: upstream amplification primer 99-2001 for SEQ 1047,
ctttcttcaacattactttcc

SEQ ID NO: 4982 - DNA, 18 bp, Homo Sapiens
  primer_bind 1..18: upstream amplification primer 99-20011 for SEQ 1048,
tagtgggagaggacattc

SEQ ID NO: 4983 - DNA, 18 bp, Homo Sapiens
  primer_bind 1..18: upstream amplification primer 99-20018 for SEQ 1049,
tcacactttcccctttcc

SEQ ID NO: 4984 - DNA, 18 bp, Homo Sapiens
  primer_bind 1..18: upstream amplification primer 99-20023 for SEQ 1050,
gtatatttgcaggctgag

SEQ ID NO: 4985 - DNA, 20 bp, Homo Sapiens
  primer_bind 1..20: upstream amplification primer 99-2003 for SEQ 1051,
ccacagagtaaagtaaaaag

SEQ ID NO: 4986 - DNA, 19 bp, Homo Sapiens
  primer_bind 1..19: upstream amplification primer 99-20032 for SEQ 1052,
gattcccaggacataatac

SEQ ID NO: 4987 - DNA, 20 bp, Homo Sapiens
  primer_bind 1..20: upstream amplification primer 99-20033 for SEQ 1053,
ctgagctgagcagtaattag

SEQ ID NO: 4988 - DNA, 18 bp, Homo Sapiens
  primer_bind 1..18: upstream amplification primer 99-20035 for SEQ 1054,
tcaggtgaagaatgaggg

SEQ ID NO: 4989 - DNA, 19 bp, Homo Sapiens
  primer_bind 1..19: upstream amplification primer 99-2004 for SEQ 1055,
cataaatctacacatcacc

SEQ ID NO: 4990 - DNA, 20 bp, Homo Sapiens
  primer_bind 1..20: upstream amplification primer 99-2005 for SEQ 1056,
gactgggactatttatgttg

SEQ ID NO: 4991 - DNA, 19 bp, Homo Sapiens
  primer_bind 1..19: upstream amplification primer 99-20057 for SEQ 1057,
ttggaaaaaacttggactg

SEQ ID NO: 4992 - DNA, 20 bp, Homo Sapiens
  primer_bind 1..20: upstream amplification primer 99-20061 for SEQ 1058,
ggggaactgaagattatttg

SEQ ID NO: 4993 - DNA, 18 bp, Homo Sapiens
  primer_bind 1..18: upstream amplification primer 99-20062 for SEQ 1059,
agaatgggtgaatttggg

SEQ ID NO: 4994 - DNA, 19 bp, Homo Sapiens
  primer_bind 1..19: upstream amplification primer 99-2007 for SEQ 1060,
taaaggaagagagagaaag

SEQ ID NO: 4995 - DNA, 20 bp, Homo Sapiens
  primer_bind 1..20: upstream amplification primer 99-20074 for SEQ 1061,
atttgggcagggggttgaag

SEQ ID NO: 4996 - DNA, 18 bp, Homo Sapiens
  primer_bind 1..18: upstream amplification primer 99-20090 for SEQ 1062,
ttagtcatagaaggggag

SEQ ID NO: 4997 - DNA, 18 bp, Homo Sapiens
  primer_bind 1..18: upstream amplification primer 99-2010 for SEQ 1063,
gtttttttgtcccccacc

SEQ ID NO: 4998 - DNA, 19 bp, Homo Sapiens
  primer_bind 1..19: upstream amplification primer 99-20110 for SEQ 1064,
gtcagattattcagggtag

SEQ ID NO: 4999 - DNA, 20 bp, Homo Sapiens
  primer_bind 1..20: upstream amplification primer 99-2012 for SEQ 1065,
cccataaaaaatcccaatag

SEQ ID NO: 5000 - DNA, 19 bp, Homo Sapiens
  primer_bind 1..19: upstream amplification primer 99-20154 for SEQ 1066,
ttctcaatgataagactcc

SEQ ID NO: 5001 - DNA, 18 bp, Homo Sapiens
  primer_bind 1..18: upstream amplification primer 99-20156 for SEQ 1067,
ataggttggttgaaggag

SEQ ID NO: 5002 - DNA, 19 bp, Homo Sapiens
  primer_bind 1..19: upstream amplification primer 99-20198 for SEQ 1068,
ttccaccttctgtccttcc

SEQ ID NO: 5003 - DNA, 20 bp, Homo Sapiens
  primer_bind 1..20: upstream amplification primer 99-2020 for SEQ 1069,
tcttcctgcctttccacctc

SEQ ID NO: 5004 - DNA, 20 bp, Homo Sapiens
  primer_bind 1..20: upstream amplification primer 99-20208 for SEQ 1070,
gggtattattgttacttgtc

SEQ ID NO: 5005 - DNA, 19 bp, Homo Sapiens
  primer_bind 1..19: upstream amplification primer 99-2022 for SEQ 1071,
gggaactaagtaagtgctg

SEQ ID NO: 5006 - DNA, 19 bp, Homo Sapiens
  primer_bind 1..19: upstream amplification primer 99-2024 for SEQ 1072,
aggacaaaaaactctttgg

SEQ ID NO: 5007 - DNA, 19 bp, Homo Sapiens
  primer_bind 1..19: upstream amplification primer 99-2025 for SEQ 1073,
catgacctcatgtgtcttg

SEQ ID NO: 5008 - DNA, 18 bp, Homo Sapiens
  primer_bind 1..18: upstream amplification primer 99-20250 for SEQ 1074,
ttagccaccccgtctttg

SEQ ID NO: 5009 - DNA, 20 bp, Homo Sapiens
  primer_bind 1..20: upstream amplification primer 99-2027 for SEQ 1075,
gtgatgaatgatttttgagg

SEQ ID NO: 5010 - DNA, 20 bp, Homo Sapiens
  primer_bind 1..20: upstream amplification primer 99-20294 for SEQ 1076,
ccttgaacgaaactttgtcc

SEQ ID NO: 5011 - DNA, 18 bp, Homo Sapiens
  primer_bind 1..18: upstream amplification primer 99-20303 for SEQ 1077,
ttctaccatcgtgtgctc

SEQ ID NO: 5012 - DNA, 18 bp, Homo Sapiens
  primer_bind 1..18: upstream amplification primer 99-20313 for SEQ 1078,
gtattgctcctgtgtttc

SEQ ID NO: 5013 - DNA, 18 bp, Homo Sapiens
  primer_bind 1..18: upstream amplification primer 99-20320 for SEQ 1079,
gtaatagaatcctgctcc

SEQ ID NO: 5014 - DNA, 20 bp, Homo Sapiens
  primer_bind 1..20: upstream amplification primer 99-20326 for SEQ 1080,
ctgaacatgctcaactgaag

SEQ ID NO: 5015 - DNA, 18 bp, Homo Sapiens
  primer_bind 1..18: upstream amplification primer 99-20332 for SEQ 1081,
ggaaagactgaacaaagg

SEQ ID NO: 5016 - DNA, 18 bp, Homo Sapiens
  primer_bind 1..18: upstream amplification primer 99-20335 for SEQ 1082,
ggtatctgtggttaaggg

SEQ ID NO: 5017 - DNA, 18 bp, Homo Sapiens
  primer_bind 1..18: upstream amplification primer 99-20340 for SEQ 1083,
gctttgatagagtcacag

SEQ ID NO: 5018 - DNA, 19 bp, Homo Sapiens
  primer_bind 1..19: upstream amplification primer 99-20348 for SEQ 1084,
tggtcacaatgctaatatg

SEQ ID NO: 5019 - DNA, 20 bp, Homo Sapiens
  primer_bind 1..20: upstream amplification primer 99-2035 for SEQ 1085,
cgtgtttattaaggaggaag

SEQ ID NO: 5020 - DNA, 19 bp, Homo Sapiens
  primer_bind 1..19: upstream amplification primer 99-20353 for SEQ 1086,
ttggggacaagaccgatac

SEQ ID NO: 5021 - DNA, 19 bp, Homo Sapiens
  primer_bind 1..19: upstream amplification primer 99-20357 for SEQ 1087,
aacagggtagtgttacgtg

SEQ ID NO: 5022 - DNA, 19 bp, Homo Sapiens
  primer_bind 1..19: upstream amplification primer 99-2036 for SEQ 1088,
aatgagaagccgctctcac

SEQ ID NO: 5023 - DNA, 19 bp, Homo Sapiens
  primer_bind 1..19: upstream amplification primer 99-2037 for SEQ 1089,
caagctatgtcaaaatgag

SEQ ID NO: 5024 - DNA, 21 bp, Homo Sapiens
  primer_bind 1..21: upstream amplification primer 99-20385 for SEQ 1090,
gaagctggaaagaaagcagag

SEQ ID NO: 5025 - DNA, 21 bp, Homo Sapiens
  primer_bind 1..21: upstream amplification primer 99-2041 for SEQ 1091,
ctattattaccttcttcaggg

SEQ ID NO: 5026 - DNA, 18 bp, Homo Sapiens
  primer_bind 1..18: upstream amplification primer 99-2042 for SEQ 1092,
cttgactcccactatctc

SEQ ID NO: 5027 - DNA, 20 bp, Homo Sapiens
  primer_bind 1..20: upstream amplification primer 99-20420 for SEQ 1093,
ccttgaacgaaactttgtcc

SEQ ID NO: 5028 - DNA, 18 bp, Homo Sapiens
  primer_bind 1..18: upstream amplification primer 99-20423 for SEQ 1094,
ggggggaaaaaagaacac

SEQ ID NO: 5029 - DNA, 18 bp, Homo Sapiens
  primer_bind 1..18: upstream amplification primer 99-20424 for SEQ 1095,
ctgtaagagccatcagtg

SEQ ID NO: 5030 - DNA, 19 bp, Homo Sapiens
  primer_bind 1..19: upstream amplification primer 99-20428 for SEQ 1096,
aggggggaaaataaaaatc

SEQ ID NO: 5031 - DNA, 18 bp, Homo Sapiens
  primer_bind 1..18: upstream amplification primer 99-2043 for SEQ 1097,
gaagggctcctcaagcac

SEQ ID NO: 5032 - DNA, 18 bp, Homo Sapiens
  primer_bind 1..18: upstream amplification primer 99-2046 for SEQ 1098,
ttgcccagagaaagttcc

SEQ ID NO: 5033 - DNA, 18 bp, Homo Sapiens
  primer_bind 1..18: upstream amplification primer 99-20469 for SEQ 1099,
tatttgttagccagtccc

SEQ ID NO: 5034 - DNA, 19 bp, Homo Sapiens
  primer_bind 1..19: upstream amplification primer 99-2048 for SEQ 1100,
aatctgtggctttgttttc

SEQ ID NO: 5035 - DNA, 20 bp, Homo Sapiens
  primer_bind 1..20: upstream amplification primer 99-20480 for SEQ 1101,
tgctgggtactggcatcaag

SEQ ID NO: 5036 - DNA, 21 bp, Homo Sapiens
  primer_bind 1..21: upstream amplification primer 99-20481 for SEQ 1102,
gaaaagaaatactgacacttg

SEQ ID NO: 5037 - DNA, 20 bp, Homo Sapiens
  primer_bind 1..20: upstream amplification primer 99-20485 for SEQ 1103,
aaaggacgtgggctacagtg

SEQ ID NO: 5038 - DNA, 21 bp, Homo Sapiens
  primer_bind 1..21: upstream amplification primer 99-20493 for SEQ 1104,
gccctatcctattaccatttc

SEQ ID NO: 5039 - DNA, 19 bp, Homo Sapiens
  primer_bind 1..19: upstream amplification primer 99-20499 for SEQ 1105,
gattgttcaactgacctcc

SEQ ID NO: 5040 - DNA, 19 bp, Homo Sapiens
  primer_bind 1..19: upstream amplification primer 99-20504 for SEQ 1106,
gattgttcatctcactccc

SEQ ID NO: 5041 - DNA, 19 bp, Homo Sapiens
  primer_bind 1..19: upstream amplification primer 99-20508 for SEQ 1107,
tgttgagttgaaggcaggc

SEQ ID NO: 5042 - DNA, 19 bp, Homo Sapiens
  primer_bind 1..19: upstream amplification primer 99-2051 for SEQ 1108,
tcaactttataatggtggg

SEQ ID NO: 5043 - DNA, 20 bp, Homo Sapiens
  primer_bind 1..20: upstream amplification primer 99-20511 for SEQ 1109,
ctccttactcacttaacacc

SEQ ID NO: 5044 - DNA, 20 bp, Homo Sapiens
  primer_bind 1..20: upstream amplification primer 99-20514 for SEQ 1110,
cttaacaccatgtctctttc

SEQ ID NO: 5045 - DNA, 21 bp, Homo Sapiens
  primer_bind 1..21: upstream amplification primer 99-20518 for SEQ 1111,
gataccaacattatactaagc

SEQ ID NO: 5046 - DNA, 18 bp, Homo Sapiens
  primer_bind 1..18: upstream amplification primer 99-2052 for SEQ 1112,
aaatatgtgccgtgccag

SEQ ID NO: 5047 - DNA, 19 bp, Homo Sapiens
  primer_bind 1..19: upstream amplification primer 99-20527 for SEQ 1113,
aaagtaggaaatttgcagg

SEQ ID NO: 5048 - DNA, 18 bp, Homo Sapiens
  primer_bind 1..18: upstream amplification primer 99-2053 for SEQ 1114,
attaatgcacccacttcc

SEQ ID NO: 5049 - DNA, 19 bp, Homo Sapiens
  primer_bind 1..19: upstream amplification primer 99-20531 for SEQ 1115,
tggagagatatagatgaag

SEQ ID NO: 5050 - DNA, 18 bp, Homo Sapiens
  primer_bind 1..18: upstream amplification primer 99-2054 for SEQ 1116,
acaatgaactgttcaggg

SEQ ID NO: 5051 - DNA, 19 bp, Homo Sapiens
  primer_bind 1..19: upstream amplification primer 99-20542 for SEQ 1117,
tagaacagacaatcaacag

SEQ ID NO: 5052 - DNA, 18 bp, Homo Sapiens
  primer_bind 1..18: upstream amplification primer 99-20549 for SEQ 1118,
ttccattcttctcctctc

SEQ ID NO: 5053 - DNA, 18 bp, Homo Sapiens
  primer_bind 1..18: upstream amplification primer 99-2055 for SEQ 1119,
tgaatctgatgtggtagg

SEQ ID NO: 5054 - DNA, 18 bp, Homo Sapiens
  primer_bind 1..18: upstream amplification primer 99-20552 for SEQ 1120,
accttcccaaactcttcc

SEQ ID NO: 5055 - DNA, 19 bp, Homo Sapiens
  primer_bind 1..19: upstream amplification primer 99-2056 for SEQ 1121,
gagaaaagggaggtaaaag

SEQ ID NO: 5056 - DNA, 18 bp, Homo Sapiens
  primer_bind 1..18: upstream amplification primer 99-20561 for SEQ 1122,
aaacctgagttcggagtg

SEQ ID NO: 5057 - DNA, 19 bp, Homo Sapiens
  primer_bind 1..19: upstream amplification primer 99-20565 for SEQ 1123,
gttagggagtaggaaaaag

SEQ ID NO: 5058 - DNA, 19 bp, Homo Sapiens
  primer_bind 1..19: upstream amplification primer 99-20566 for SEQ 1124,
aatccttaactttcttccc

SEQ ID NO: 5059 - DNA, 18 bp, Homo Sapiens
  primer_bind 1..18: upstream amplification primer 99-20567 for SEQ 1125,
taagattagcccagcctc

SEQ ID NO: 5060 - DNA, 19 bp, Homo Sapiens
  primer_bind 1..19: upstream amplification primer 99-20568 for SEQ 1126,
atatgaggagtgatctttg

SEQ ID NO: 5061 - DNA, 18 bp, Homo Sapiens
  primer_bind 1..18: upstream amplification primer 99-2058 for SEQ 1127,
tcctggaggggatctgac

SEQ ID NO: 5062 - DNA, 19 bp, Homo Sapiens
  primer_bind 1..19: upstream amplification primer 99-20581 for SEQ 1128,
catcatcattctcaactcc

SEQ ID NO: 5063 - DNA, 18 bp, Homo Sapiens
  primer_bind 1..18: upstream amplification primer 99-20594 for SEQ 1129,
caggtagtgtaaagctgc

SEQ ID NO: 5064 - DNA, 18 bp, Homo Sapiens
  primer_bind 1..18: upstream amplification primer 99-2060 for SEQ 1130,
cactgtaatcaactgccc

SEQ ID NO: 5065 - DNA, 20 bp, Homo Sapiens
  primer_bind 1..20: upstream amplification primer 99-2061 for SEQ 1131,
tctcccacactccactcttc

SEQ ID NO: 5066 - DNA, 18 bp, Homo Sapiens
  primer_bind 1..18: upstream amplification primer 99-20616 for SEQ 1132,
tcacagttatccaggtag

SEQ ID NO: 5067 - DNA, 18 bp, Homo Sapiens
  primer_bind 1..18: upstream amplification primer 99-20623 for SEQ 1133,
agataggaaagtcacagg

SEQ ID NO: 5068 - DNA, 18 bp, Homo Sapiens
  primer_bind 1..18: upstream amplification primer 99-2063 for SEQ 1134,
ctctccttctctcatttg

SEQ ID NO: 5069 - DNA, 18 bp, Homo Sapiens
  primer_bind 1..18: upstream amplification primer 99-20639 for SEQ 1135,
tcttgaaaattgcccctg

SEQ ID NO: 5070 - DNA, 19 bp, Homo Sapiens
  primer_bind 1..19: upstream amplification primer 99-20642 for SEQ 1136,
atagaaacagcataagtgg

SEQ ID NO: 5071 - DNA, 19 bp, Homo Sapiens
  primer_bind 1..19: upstream amplification primer 99-20651 for SEQ 1137,
gaaagtgataagagctagg

SEQ ID NO: 5072 - DNA, 19 bp, Homo Sapiens
  primer_bind 1..19: upstream amplification primer 99-20656 for SEQ 1138,
gctgtcagaaattgcatag

SEQ ID NO: 5073 - DNA, 19 bp, Homo Sapiens
  primer_bind 1..19: upstream amplification primer 99-20659 for SEQ 1139,
ccctttctgttttagattg

SEQ ID NO: 5074 - DNA, 19 bp, Homo Sapiens
  primer_bind 1..19: upstream amplification primer 99-20675 for SEQ 1140,
gttgttgtatcatttggtc

SEQ ID NO: 5075 - DNA, 18 bp, Homo Sapiens
  primer_bind 1..18: upstream amplification primer 99-20677 for SEQ 1141,
aatgttacctcttccgtg

SEQ ID NO: 5076 - DNA, 21 bp, Homo Sapiens
  primer_bind 1..21: upstream amplification primer 99-20683 for SEQ 1142,
ccatagaatgtaaaggaaaag

SEQ ID NO: 5077 - DNA, 19 bp, Homo Sapiens
  primer_bind 1..19: upstream amplification primer 99-20688 for SEQ 1143,
attgcactaatcattggac

SEQ ID NO: 5078 - DNA, 19 bp, Homo Sapiens
  primer_bind 1..19: upstream amplification primer 99-20723 for SEQ 1144,
aaaaatgggggggagtctg

SEQ ID NO: 5079 - DNA, 18 bp, Homo Sapiens
  primer_bind 1..18: upstream amplification primer 99-20726 for SEQ 1145,
tatagcaacccaagaacc

SEQ ID NO: 5080 - DNA, 18 bp, Homo Sapiens
  primer_bind 1..18: upstream amplification primer 99-20732 for SEQ 1146,
ctatcacttccttccttg

SEQ ID NO: 5081 - DNA, 18 bp, Homo Sapiens
  primer_bind 1..18: upstream amplification primer 99-20738 for SEQ 1147,
caccacttctatcccttc

SEQ ID NO: 5082 - DNA, 18 bp, Homo Sapiens
  primer_bind 1..18: upstream amplification primer 99-20739 for SEQ 1148,
ctccaataatgacccacc

SEQ ID NO: 5083 - DNA, 18 bp, Homo Sapiens
  primer_bind 1..18: upstream amplification primer 99-2074 for SEQ 1149,
tgagtttttgtgaagggg

SEQ ID NO: 5084 - DNA, 19 bp, Homo Sapiens
  primer_bind 1..19: upstream amplification primer 99-20746 for SEQ 1150,
taatcagtaacaaccatcc

SEQ ID NO: 5085 - DNA, 18 bp, Homo Sapiens
  primer_bind 1..18: upstream amplification primer 99-20747 for SEQ 1151,
ttctccaaactctactcc

SEQ ID NO: 5086 - DNA, 19 bp, Homo Sapiens
  primer_bind 1..19: upstream amplification primer 99-20766 for SEQ 1152,
ggcaacttaaatagcagac

SEQ ID NO: 5087 - DNA, 18 bp, Homo Sapiens
  primer_bind 1..18: upstream amplification primer 99-20768 for SEQ 1153,
gacttacttctctttgcc

SEQ ID NO: 5088 - DNA, 20 bp, Homo Sapiens
  primer_bind 1..20: upstream amplification primer 99-2077 for SEQ 1154,
ccacagagtaaagtaaaaag

SEQ ID NO: 5089 - DNA, 19 bp, Homo Sapiens
  primer_bind 1..19: upstream amplification primer 99-20771 for SEQ 1155,
acacaccccctggtttttc

SEQ ID NO: 5090 - DNA, 20 bp, Homo Sapiens
  primer_bind 1..20: upstream amplification primer 99-2078 for SEQ 1156,
gtgtctaatctgattctaac

SEQ ID NO: 5091 - DNA, 20 bp, Homo Sapiens
  primer_bind 1..20: upstream amplification primer 99-20797 for SEQ 1157,
tgggatagaggtgggaatgg

SEQ ID NO: 5092 - DNA, 20 bp, Homo Sapiens
  primer_bind 1..20: upstream amplification primer 99-20798 for SEQ 1158,
gaaatgaagttggattagtg

SEQ ID NO: 5093 - DNA, 20 bp, Homo Sapiens
  primer_bind 1..20: upstream amplification primer 99-2080 for SEQ 1159,
tacagggacgagtggatgac

SEQ ID NO: 5094 - DNA, 18 bp, Homo Sapiens
  primer_bind 1..18: upstream amplification primer 99-20802 for SEQ 1160,
ctgccatcgctgtaaatc

SEQ ID NO: 5095 - DNA, 18 bp, Homo Sapiens
  primer_bind 1..18: upstream amplification primer 99-20814 for SEQ 1161,
taggggctaatatagtgg

SEQ ID NO: 5096 - DNA, 20 bp, Homo Sapiens
  primer_bind 1..20: upstream amplification primer 99-2082 for SEQ 1162,
agtggtcggggttcatcttc

SEQ ID NO: 5097 - DNA, 19 bp, Homo Sapiens
  primer_bind 1..19: upstream amplification primer 99-20823 for SEQ 1163,
cttgcagagatttaaaagg

SEQ ID NO: 5098 - DNA, 18 bp, Homo Sapiens
  primer_bind 1..18: upstream amplification primer 99-20828 for SEQ 1164,
gtatttacggtggagtgg

SEQ ID NO: 5099 - DNA, 18 bp, Homo Sapiens
  primer_bind 1..18: upstream amplification primer 99-20830 for SEQ 1165,
cttcttcccaaatctgtc

SEQ ID NO: 5100 - DNA, 19 bp, Homo Sapiens
  primer_bind 1..19: upstream amplification primer 99-2084 for SEQ 1166,
ttctttattctggctcttc

SEQ ID NO: 5101 - DNA, 18 bp, Homo Sapiens
  primer_bind 1..18: upstream amplification primer 99-2085 for SEQ 1167,
ggtttgagcactattgtc

SEQ ID NO: 5102 - DNA, 18 bp, Homo Sapiens
  primer_bind 1..18: upstream amplification primer 99-20850 for SEQ 1168,
gcagcaatttagtgatgg

SEQ ID NO: 5103 - DNA, 18 bp, Homo Sapiens
  primer_bind 1..18: upstream amplification primer 99-20853 for SEQ 1169,
catccaccatctcatctc

SEQ ID NO: 5104 - DNA, 21 bp, Homo Sapiens
  primer_bind 1..21: upstream amplification primer 99-20856 for SEQ 1170,
accatgctgattttaaatccc

SEQ ID NO: 5105 - DNA, 19 bp, Homo Sapiens
  primer_bind 1..19: upstream amplification primer 99-20867 for SEQ 1171,
caccacagtttgatgatag

SEQ ID NO: 5106 - DNA, 19 bp, Homo Sapiens
  primer_bind 1..19: upstream amplification primer 99-20872 for SEQ 1172,
gcgtgttatcatcttcttg

SEQ ID NO: 5107 - DNA, 18 bp, Homo Sapiens
  primer_bind 1..18: upstream amplification primer 99-20883 for SEQ 1173,
agcatttggttttccctc

SEQ ID NO: 5108 - DNA, 20 bp, Homo Sapiens
  primer_bind 1..20: upstream amplification primer 99-20887 for SEQ 1174,
gtccttgatatgacactttc

SEQ ID NO: 5109 - DNA, 18 bp, Homo Sapiens
  primer_bind 1..18: upstream amplification primer 99-2089 for SEQ 1175,
agcagcactattcctaac

SEQ ID NO: 5110 - DNA, 21 bp, Homo Sapiens
  primer_bind 1..21: upstream amplification primer 99-20895 for SEQ 1176,
ctttccctgaactgtatattg

SEQ ID NO: 5111 - DNA, 20 bp, Homo Sapiens
  primer_bind 1..20: upstream amplification primer 99-2092 for SEQ 1177,
acggctttgtgcggactttc

SEQ ID NO: 5112 - DNA, 18 bp, Homo Sapiens
  primer_bind 1..18: upstream amplification primer 99-20928 for SEQ 1178,
gccatactgtaaaacctc

SEQ ID NO: 5113 - DNA, 18 bp, Homo Sapiens
  primer_bind 1..18: upstream amplification primer 99-2093 for SEQ 1179,
atcttggttgttaggctg

SEQ ID NO: 5114 - DNA, 18 bp, Homo Sapiens
  primer_bind 1..18: upstream amplification primer 99-20938 for SEQ 1180,
tgatatgtcaatgggtgg

SEQ ID NO: 5115 - DNA, 19 bp, Homo Sapiens
  primer_bind 1..19: upstream amplification primer 99-2094 for SEQ 1181,
aataacaacagtctggatg

SEQ ID NO: 5116 - DNA, 19 bp, Homo Sapiens
  primer_bind 1..19: upstream amplification primer 99-20950 for SEQ 1182,
acagagaggtactaggtgg

SEQ ID NO: 5117 - DNA, 18 bp, Homo Sapiens
  primer_bind 1..18: upstream amplification primer 99-2098 for SEQ 1183,
aggcattaacattggcag

SEQ ID NO: 5118 - DNA, 19 bp, Homo Sapiens
  primer_bind 1..19: upstream amplification primer 99-21012 for SEQ 1184,
atacacaccatagacaaag

SEQ ID NO: 5119 - DNA, 19 bp, Homo Sapiens
  primer_bind 1..19: upstream amplification primer 99-21021 for SEQ 1185,
gtactcttatggtgcattg

SEQ ID NO: 5120 - DNA, 18 bp, Homo Sapiens
  primer_bind 1..18: upstream amplification primer 99-2103 for SEQ 1186,
cctggattctgacccatc

SEQ ID NO: 5121 - DNA, 18 bp, Homo Sapiens
  primer_bind 1..18: upstream amplification primer 99-21035 for SEQ 1187,
atgaccagagatacccag

SEQ ID NO: 5122 - DNA, 18 bp, Homo Sapiens
  primer_bind 1..18: upstream amplification primer 99-21064 for SEQ 1188,
ccttctctctcttttccc

SEQ ID NO: 5123 - DNA, 19 bp, Homo Sapiens
  primer_bind 1..19: upstream amplification primer 99-21070 for SEQ 1189,
gggaataatcgctaataac

SEQ ID NO: 5124 - DNA, 18 bp, Homo Sapiens
  primer_bind 1..18: upstream amplification primer 99-21079 for SEQ 1190,
ccatgtttccagaacttc

SEQ ID NO: 5125 - DNA, 18 bp, Homo Sapiens
  primer_bind 1..18: upstream amplification primer 99-21084 for SEQ 1191,
tgcaacactggctttagg

SEQ ID NO: 5126 - DNA, 19 bp, Homo Sapiens
  primer_bind 1..19: upstream amplification primer 99-2109 for SEQ 1192,
tacctgacactttttgaac

SEQ ID NO: 5127 - DNA, 18 bp, Homo Sapiens
  primer_bind 1..18: upstream amplification primer 99-211 for SEQ 1193,
tccttacttgtaaccccc

SEQ ID NO: 5128 - DNA, 18 bp, Homo Sapiens
  primer_bind 1..18: upstream amplification primer 99-21141 for SEQ 1194,
atgatggtgagaagagtg

SEQ ID NO: 5129 - DNA, 19 bp, Homo Sapiens
  primer_bind 1..19: upstream amplification primer 99-21148 for SEQ 1195,
gtaaagtgaacaaagtgag

SEQ ID NO: 5130 - DNA, 20 bp, Homo Sapiens
  primer_bind 1..20: upstream amplification primer 99-21149 for SEQ 1196,
taatggtgtagtcataggag

SEQ ID NO: 5131 - DNA, 20 bp, Homo Sapiens
  primer_bind 1..20: upstream amplification primer 99-21167 for SEQ 1197,
agcccctgcaaacatcctac

SEQ ID NO: 5132 - DNA, 18 bp, Homo Sapiens
  primer_bind 1..18: upstream amplification primer 99-2117 for SEQ 1198,
acgcaccctgtaagtttc

SEQ ID NO: 5133 - DNA, 19 bp, Homo Sapiens
  primer_bind 1..19: upstream amplification primer 99-21221 for SEQ 1199,
tttccaggagaaggagcac

SEQ ID NO: 5134 - DNA, 19 bp, Homo Sapiens
  primer_bind 1..19: upstream amplification primer 99-2126 for SEQ 1200,
ggaaaccatagacaaaaag

SEQ ID NO: 5135 - DNA, 19 bp, Homo Sapiens
  primer_bind 1..19: upstream amplification primer 99-21370 for SEQ 1201,
tctgactttctctggcagg

SEQ ID NO: 5136 - DNA, 21 bp, Homo Sapiens
  primer_bind 1..21: upstream amplification primer 99-2170 for SEQ 1202,
ccattcaggtgctgggaatac

SEQ ID NO: 5137 - DNA, 19 bp, Homo Sapiens
  primer_bind 1..19: upstream amplification primer 99-2172 for SEQ 1203,
taaaagtcaacttgagagg

SEQ ID NO: 5138 - DNA, 20 bp, Homo Sapiens
  primer_bind 1..20: upstream amplification primer 99-2173 for SEQ 1204,
gaggtgagaggtaatttatc

SEQ ID NO: 5139 - DNA, 18 bp, Homo Sapiens
  primer_bind 1..18: upstream amplification primer 99-2179 for SEQ 1205,
gaggggaaaaacttgatg

SEQ ID NO: 5140 - DNA, 19 bp, Homo Sapiens
  primer_bind 1..19: upstream amplification primer 99-2193 for SEQ 1206,
aatctttgctaaactgacc

SEQ ID NO: 5141 - DNA, 18 bp, Homo Sapiens
  primer_bind 1..18: upstream amplification primer 99-22011 for SEQ 1207,
cccagaagcatttttgac

SEQ ID NO: 5142 - DNA, 19 bp, Homo Sapiens
  primer_bind 1..19: upstream amplification primer 99-22015 for SEQ 1208,
ttgaagaatgctaaggaac

SEQ ID NO: 5143 - DNA, 21 bp, Homo Sapiens
  primer_bind 1..21: upstream amplification primer 99-22022 for SEQ 1209,
acactcacttcaaaatgccac

SEQ ID NO: 5144 - DNA, 20 bp, Homo Sapiens
  primer_bind 1..20: upstream amplification primer 99-22027 for SEQ 1210,
gtcctaaagttatatttggc

SEQ ID NO: 5145 - DNA, 19 bp, Homo Sapiens
  primer_bind 1..19: upstream amplification primer 99-22036 for SEQ 1211,
aaagtcacatttagaaggg

SEQ ID NO: 5146 - DNA, 19 bp, Homo Sapiens
  primer_bind 1..19: upstream amplification primer 99-22038 for SEQ 1212,
tgtcctatactcgtttttc

SEQ ID NO: 5147 - DNA, 18 bp, Homo Sapiens
  primer_bind 1..18: upstream amplification primer 99-22044 for SEQ 1213,
taatacacacactccccc

SEQ ID NO: 5148 - DNA, 18 bp, Homo Sapiens
  primer_bind 1..18: upstream amplification primer 99-22048 for SEQ 1214,
gtgggaattgtgggtatg

SEQ ID NO: 5149 - DNA, 19 bp, Homo Sapiens
  primer_bind 1..19: upstream amplification primer 99-22051 for SEQ 1215,
tatacacatcactctcttc

SEQ ID NO: 5150 - DNA, 18 bp, Homo Sapiens
  primer_bind 1..18: upstream amplification primer 99-22066 for SEQ 1216,
gagagagataaggatgac

SEQ ID NO: 5151 - DNA, 18 bp, Homo Sapiens
  primer_bind 1..18: upstream amplification primer 99-22072 for SEQ 1217,
ctatttatcttctccccc

SEQ ID NO: 5152 - DNA, 19 bp, Homo Sapiens
  primer_bind 1..19: upstream amplification primer 99-22073 for SEQ 1218,
ttacctggctctctccttc

SEQ ID NO: 5153 - DNA, 19 bp, Homo Sapiens
  primer_bind 1..19: upstream amplification primer 99-22078 for SEQ 1219,
ctcaagaagaagaatacac

SEQ ID NO: 5154 - DNA, 19 bp, Homo Sapiens
  primer_bind 1..19: upstream amplification primer 99-22087 for SEQ 1220,
ggtatgtaattcacagtgg

SEQ ID NO: 5155 - DNA, 18 bp, Homo Sapiens
  primer_bind 1..18: upstream amplification primer 99-2209 for SEQ 1221,
ggaatgagagtaggaaag

SEQ ID NO: 5156 - DNA, 20 bp, Homo Sapiens
  primer_bind 1..20: upstream amplification primer 99-22091 for SEQ 1222,
atgtatgtaagtatagaggg

SEQ ID NO: 5157 - DNA, 18 bp, Homo Sapiens
  primer_bind 1..18: upstream amplification primer 99-22096 for SEQ 1223,
agtcctcctcaaggttag

SEQ ID NO: 5158 - DNA, 18 bp, Homo Sapiens
  primer_bind 1..18: upstream amplification primer 99-22100 for SEQ 1224,
agtcatatacgtgatggg

SEQ ID NO: 5159 - DNA, 18 bp, Homo Sapiens
  primer_bind 1..18: upstream amplification primer 99-22102 for SEQ 1225,
acacagaggagcatgttg

SEQ ID NO: 5160 - DNA, 21 bp, Homo Sapiens
  primer_bind 1..21: upstream amplification primer 99-22122 for SEQ 1226,
atgagtgaagagattgaaagg

SEQ ID NO: 5161 - DNA, 18 bp, Homo Sapiens
  primer_bind 1..18: upstream amplification primer 99-22125 for SEQ 1227,
tctcctacattctagctc

SEQ ID NO: 5162 - DNA, 19 bp, Homo Sapiens
  primer_bind 1..19: upstream amplification primer 99-2214 for SEQ 1228,
ccattcagattcaaatgag

SEQ ID NO: 5163 - DNA, 20 bp, Homo Sapiens
  primer_bind 1..20: upstream amplification primer 99-22147 for SEQ 1229,
gaaaagaatagattcagacg

SEQ ID NO: 5164 - DNA, 19 bp, Homo Sapiens
  primer_bind 1..19: upstream amplification primer 99-22160 for SEQ 1230,
tttacatgaagaaggggac

SEQ ID NO: 5165 - DNA, 19 bp, Homo Sapiens
  primer_bind 1..19: upstream amplification primer 99-22167 for SEQ 1231,
tccacgatgacatctgtcc

SEQ ID NO: 5166 - DNA, 21 bp, Homo Sapiens
  primer_bind 1..21: upstream amplification primer 99-22172 for SEQ 1232,
cggggttaaaaaatatgtttg

SEQ ID NO: 5167 - DNA, 19 bp, Homo Sapiens
  primer_bind 1..19: upstream amplification primer 99-2218 for SEQ 1233,
caatctctgcttagaaagg

SEQ ID NO: 5168 - DNA, 20 bp, Homo Sapiens
  primer_bind 1..20: upstream amplification primer 99-22189 for SEQ 1234,
gtttcctagttgagaaaatg

SEQ ID NO: 5169 - DNA, 20 bp, Homo Sapiens
  primer_bind 1..20: upstream amplification primer 99-2219 for SEQ 1235,
ctatcaattactgagagagg

SEQ ID NO: 5170 - DNA, 20 bp, Homo Sapiens
  primer_bind 1..20: upstream amplification primer 99-22191 for SEQ 1236,
ccaaaagccccacagcttac

SEQ ID NO: 5171 - DNA, 19 bp, Homo Sapiens
  primer_bind 1..19: upstream amplification primer 99-22192 for SEQ 1237,
ccagttttctatgattgcc

SEQ ID NO: 5172 - DNA, 20 bp, Homo Sapiens
  primer_bind 1..20: upstream amplification primer 99-222 for SEQ 1238,
aggggagatgagggaagttg

SEQ ID NO: 5173 - DNA, 21 bp, Homo Sapiens
  primer_bind 1..21: upstream amplification primer 99-2220 for SEQ 1239,
gaataaaatgagagaagacac

SEQ ID NO: 5174 - DNA, 18 bp, Homo Sapiens
  primer_bind 1..18: upstream amplification primer 99-22209 for SEQ 1240,
ttcctgccatttgctatc

SEQ ID NO: 5175 - DNA, 18 bp, Homo Sapiens
  primer_bind 1..18: upstream amplification primer 99-22215 for SEQ 1241,
ggcactgaatagagaatc

SEQ ID NO: 5176 - DNA, 20 bp, Homo Sapiens
  primer_bind 1..20: upstream amplification primer 99-22217 for SEQ 1242,
gttcatgctattcccatcac

SEQ ID NO: 5177 - DNA, 18 bp, Homo Sapiens
  primer_bind 1..18: upstream amplification primer 99-2222 for SEQ 1243,
ataagcaggctttctagg

SEQ ID NO: 5178 - DNA, 18 bp, Homo Sapiens
  primer_bind 1..18: upstream amplification primer 99-22227 for SEQ 1244,
agaggggagaagatgaac

SEQ ID NO: 5179 - DNA, 20 bp, Homo Sapiens
  primer_bind 1..20: upstream amplification primer 99-22255 for SEQ 1245,
ttcagtgacccaaactttcc

SEQ ID NO: 5180 - DNA, 18 bp, Homo Sapiens
  primer_bind 1..18: upstream amplification primer 99-22262 for SEQ 1246,
gcctttacctatgcagtg

SEQ ID NO: 5181 - DNA, 19 bp, Homo Sapiens
  primer_bind 1..19: upstream amplification primer 99-22265 for SEQ 1247,
ttgagtcattagtatcacc

SEQ ID NO: 5182 - DNA, 19 bp, Homo Sapiens
  primer_bind 1..19: upstream amplification primer 99-22266 for SEQ 1248,
ataatgcaatgatgtggag

SEQ ID NO: 5183 - DNA, 18 bp, Homo Sapiens
  primer_bind 1..18: upstream amplification primer 99-2228 for SEQ 1249,
tctacctctacctctttc

SEQ ID NO: 5184 - DNA, 19 bp, Homo Sapiens
  primer_bind 1..19: upstream amplification primer 99-2229 for SEQ 1250,
cttcccatacctctgatac

SEQ ID NO: 5185 - DNA, 18 bp, Homo Sapiens
  primer_bind 1..18: upstream amplification primer 99-22333 for SEQ 1251,
tgtgtgcattgactcacc

SEQ ID NO: 5186 - DNA, 18 bp, Homo Sapiens
  primer_bind 1..18: upstream amplification primer 99-22336 for SEQ 1252,
ctgagtaatcgtccatcc

SEQ ID NO: 5187 - DNA, 18 bp, Homo Sapiens
  primer_bind 1..18: upstream amplification primer 99-22337 for SEQ 1253,
accaattctgggtccaac

SEQ ID NO: 5188 - DNA, 18 bp, Homo Sapiens
  primer_bind 1..18: upstream amplification primer 99-2235 for SEQ 1254,
tcccctaaatcccaactc

SEQ ID NO: 5189 - DNA, 18 bp, Homo Sapiens
  primer_bind 1..18: upstream amplification primer 99-22356 for SEQ 1255,
atatatcaggatgccagc

SEQ ID NO: 5190 - DNA, 20 bp, Homo Sapiens
  primer_bind 1..20: upstream amplification primer 99-22357 for SEQ 1256,
gtatttttggttgcacatgg

SEQ ID NO: 5191 - DNA, 18 bp, Homo Sapiens
  primer_bind 1..18: upstream amplification primer 99-2240 for SEQ 1257,
ttcaacagtgaagccatc

SEQ ID NO: 5192 - DNA, 18 bp, Homo Sapiens
  primer_bind 1..18: upstream amplification primer 99-22409 for SEQ 1258,
tgagtgtaaggtgaggag

SEQ ID NO: 5193 - DNA, 18 bp, Homo Sapiens
  primer_bind 1..18: upstream amplification primer 99-2242 for SEQ 1259,
tgatgtgtgtgactcagg

SEQ ID NO: 5194 - DNA, 18 bp, Homo Sapiens
  primer_bind 1..18: upstream amplification primer 99-2244 for SEQ 1260,
atagaggaaccaaacctg

SEQ ID NO: 5195 - DNA, 21 bp, Homo Sapiens
  primer_bind 1..21: upstream amplification primer 99-22442 for SEQ 1261,
ctaaaagaaataaagagccac

SEQ ID NO: 5196 - DNA, 19 bp, Homo Sapiens
  primer_bind 1..19: upstream amplification primer 99-22449 for SEQ 1262,
cgtgaaagcaaataagacc

SEQ ID NO: 5197 - DNA, 20 bp, Homo Sapiens
  primer_bind 1..20: upstream amplification primer 99-22453 for SEQ 1263,
aactccgtttggcacaggtc

SEQ ID NO: 5198 - DNA, 20 bp, Homo Sapiens
  primer_bind 1..20: upstream amplification primer 99-22456 for SEQ 1264,
cttccctgttagggtgagtg

SEQ ID NO: 5199 - DNA, 18 bp, Homo Sapiens
  primer_bind 1..18: upstream amplification primer 99-2246 for SEQ 1265,
agcagcatggaagcaaac

SEQ ID NO: 5200 - DNA, 18 bp, Homo Sapiens
  primer_bind 1..18: upstream amplification primer 99-2248 for SEQ 1266,
ctgatgaaagtggctctc

SEQ ID NO: 5201 - DNA, 20 bp, Homo Sapiens
  primer_bind 1..20: upstream amplification primer 99-22490 for SEQ 1267,
cttccttccttcctattttc

SEQ ID NO: 5202 - DNA, 18 bp, Homo Sapiens
  primer_bind 1..18: upstream amplification primer 99-22491 for SEQ 1268,
aattgctcatcactctgg

SEQ ID NO: 5203 - DNA, 19 bp, Homo Sapiens
  primer_bind 1..19: upstream amplification primer 99-2250 for SEQ 1269,
tgtatctgaggtctaaaac

SEQ ID NO: 5204 - DNA, 19 bp, Homo Sapiens
  primer_bind 1..19: upstream amplification primer 99-22503 for SEQ 1270,
gatctttctttaagtcctc

SEQ ID NO: 5205 - DNA, 19 bp, Homo Sapiens
  primer_bind 1..19: upstream amplification primer 99-22506 for SEQ 1271,
ggaaggtagtatatgtgtg

SEQ ID NO: 5206 - DNA, 19 bp, Homo Sapiens
  primer_bind 1..19: upstream amplification primer 99-22513 for SEQ 1272,
gccttttttgttgttgttc

SEQ ID NO: 5207 - DNA, 19 bp, Homo Sapiens
  primer_bind 1..19: upstream amplification primer 99-22520 for SEQ 1273,
cctatgttctgtaatgttc

SEQ ID NO: 5208 - DNA, 18 bp, Homo Sapiens
  primer_bind 1..18: upstream amplification primer 99-22546 for SEQ 1274,
cttttattgtctctgggg

SEQ ID NO: 5209 - DNA, 19 bp, Homo Sapiens
  primer_bind 1..19: upstream amplification primer 99-22565 for SEQ 1275,
tgaaagcatacaaagcaag

SEQ ID NO: 5210 - DNA, 19 bp, Homo Sapiens
  primer_bind 1..19: upstream amplification primer 99-22571 for SEQ 1276,
taaatgcccctcccactac

SEQ ID NO: 5211 - DNA, 20 bp, Homo Sapiens
  primer_bind 1..20: upstream amplification primer 99-22573 for SEQ 1277,
gatggttatcagatggctac

SEQ ID NO: 5212 - DNA, 18 bp, Homo Sapiens
  primer_bind 1..18: upstream amplification primer 99-22578 for SEQ 1278,
tgccccttgaaaatctac

SEQ ID NO: 5213 - DNA, 18 bp, Homo Sapiens
  primer_bind 1..18: upstream amplification primer 99-22580 for SEQ 1279,
tctcaggaaatggacaac

SEQ ID NO: 5214 - DNA, 21 bp, Homo Sapiens
  primer_bind 1..21: upstream amplification primer 99-22585 for SEQ 1280,
gtagttacttccattatcttc

SEQ ID NO: 5215 - DNA, 19 bp, Homo Sapiens
  primer_bind 1..19: upstream amplification primer 99-22586 for SEQ 1281,
gaatagaaacacatgcagc

SEQ ID NO: 5216 - DNA, 19 bp, Homo Sapiens
  primer_bind 1..19: upstream amplification primer 99-22604 for SEQ 1282,
aatgggaccaaggtaggag

SEQ ID NO: 5217 - DNA, 19 bp, Homo Sapiens
  primer_bind 1..19: upstream amplification primer 99-22610 for SEQ 1283,
ctctcttgcttgtcctttg

SEQ ID NO: 5218 - DNA, 18 bp, Homo Sapiens
  primer_bind 1..18: upstream amplification primer 99-22615 for SEQ 1284,
gacttagaaaggtgagag

SEQ ID NO: 5219 - DNA, 20 bp, Homo Sapiens
  primer_bind 1..20: upstream amplification primer 99-22617 for SEQ 1285,
acttccatttattcttaccc

SEQ ID NO: 5220 - DNA, 18 bp, Homo Sapiens
  primer_bind 1..18: upstream amplification primer 99-22620 for SEQ 1286,
taaaatagcaacccccag

SEQ ID NO: 5221 - DNA, 19 bp, Homo Sapiens
  primer_bind 1..19: upstream amplification primer 99-22628 for SEQ 1287,
catagtcattccttccttc

SEQ ID NO: 5222 - DNA, 18 bp, Homo Sapiens
  primer_bind 1..18: upstream amplification primer 99-22629 for SEQ 1288,
taaatgagtgacctgctg

SEQ ID NO: 5223 - DNA, 19 bp, Homo Sapiens
  primer_bind 1..19: upstream amplification primer 99-22632 for SEQ 1289,
gactcccatctgaaaaacc

SEQ ID NO: 5224 - DNA, 18 bp, Homo Sapiens
  primer_bind 1..18: upstream amplification primer 99-22646 for SEQ 1290,
attacacacctgtcagcc

SEQ ID NO: 5225 - DNA, 19 bp, Homo Sapiens
  primer_bind 1..19: upstream amplification primer 99-22648 for SEQ 1291,
tcttggagtacagaggagg

SEQ ID NO: 5226 - DNA, 19 bp, Homo Sapiens
  primer_bind 1..19: upstream amplification primer 99-22650 for SEQ 1292,
aagttgggagcggagatag

SEQ ID NO: 5227 - DNA, 18 bp, Homo Sapiens
  primer_bind 1..18: upstream amplification primer 99-22652 for SEQ 1293,
tagtcagcccaaatgctc

SEQ ID NO: 5228 - DNA, 19 bp, Homo Sapiens
  primer_bind 1..19: upstream amplification primer 99-22655 for SEQ 1294,
ctcatctcccatacaattc

SEQ ID NO: 5229 - DNA, 20 bp, Homo Sapiens
  primer_bind 1..20: upstream amplification primer 99-22660 for SEQ 1295,
ctattatcaaagtcttgcag

SEQ ID NO: 5230 - DNA, 18 bp, Homo Sapiens
  primer_bind 1..18: upstream amplification primer 99-22662 for SEQ 1296,
tgtgatgtatctgtcagg

SEQ ID NO: 5231 - DNA, 19 bp, Homo Sapiens
  primer_bind 1..19: upstream amplification primer 99-22666 for SEQ 1297,
cttggatggtttatgttgg

SEQ ID NO: 5232 - DNA, 18 bp, Homo Sapiens
  primer_bind 1..18: upstream amplification primer 99-22668 for SEQ 1298,
tgtttttcccagcgttcc

SEQ ID NO: 5233 - DNA, 19 bp, Homo Sapiens
  primer_bind 1..19: upstream amplification primer 99-22674 for SEQ 1299,
tacttctccgttaattctc

SEQ ID NO: 5234 - DNA, 20 bp, Homo Sapiens
  primer_bind 1..20: upstream amplification primer 99-22675 for SEQ 1300,
catttcaagaatgcaatgag

SEQ ID NO: 5235 - DNA, 20 bp, Homo Sapiens
  primer_bind 1..20: upstream amplification primer 99-22680 for SEQ 1301,
ttgtggtgtggaggtaaggg

SEQ ID NO: 5236 - DNA, 18 bp, Homo Sapiens
  primer_bind 1..18: upstream amplification primer 99-22683 for SEQ 1302,
atcggactctaaatgcgg

SEQ ID NO: 5237 - DNA, 19 bp, Homo Sapiens
  primer_bind 1..19: upstream amplification primer 99-2269 for SEQ 1303,
aggctaagaaaaaaagagg

SEQ ID NO: 5238 - DNA, 20 bp, Homo Sapiens
  primer_bind 1..20: upstream amplification primer 99-22700 for SEQ 1304,
taaggaagacctgccctgac

SEQ ID NO: 5239 - DNA, 21 bp, Homo Sapiens
  primer_bind 1..21: upstream amplification primer 99-22701 for SEQ 1305,
cattaagaattttcaagcagg

SEQ ID NO: 5240 - DNA, 19 bp, Homo Sapiens
  primer_bind 1..19: upstream amplification primer 99-2271 for SEQ 1306,
tgaaaagactaagttctgg

SEQ ID NO: 5241 - DNA, 21 bp, Homo Sapiens
  primer_bind 1..21: upstream amplification primer 99-22712 for SEQ 1307,
gaagcgttaaaaaatgtgatg

SEQ ID NO: 5242 - DNA, 21 bp, Homo Sapiens
  primer_bind 1..21: upstream amplification primer 99-22718 for SEQ 1308,
ctgactcagagccagcatttc

SEQ ID NO: 5243 - DNA, 18 bp, Homo Sapiens
  primer_bind 1..18: upstream amplification primer 99-2272 for SEQ 1309,
atgctagaggaaaggaac

SEQ ID NO: 5244 - DNA, 19 bp, Homo Sapiens
  primer_bind 1..19: upstream amplification primer 99-22728 for SEQ 1310,
tttaaacactgatctgcac

SEQ ID NO: 5245 - DNA, 18 bp, Homo Sapiens
  primer_bind 1..18: upstream amplification primer 99-2273 for SEQ 1311,
ataccagggactttagtg

SEQ ID NO: 5246 - DNA, 19 bp, Homo Sapiens
  primer_bind 1..19: upstream amplification primer 99-22733 for SEQ 1312,
agcagtaacaaatatgcag

SEQ ID NO: 5247 - DNA, 19 bp, Homo Sapiens
  primer_bind 1..19: upstream amplification primer 99-22741 for SEQ 1313,
gttgttttactggtctatc

SEQ ID NO: 5248 - DNA, 19 bp, Homo Sapiens
  primer_bind 1..19: upstream amplification primer 99-2275 for SEQ 1314,
agattcagaccaatttcac

SEQ ID NO: 5249 - DNA, 18 bp, Homo Sapiens
  primer_bind 1..18: upstream amplification primer 99-2276 for SEQ 1315,
ctgggagaatactgagac

SEQ ID NO: 5250 - DNA, 18 bp, Homo Sapiens
  primer_bind 1..18: upstream amplification primer 99-22771 for SEQ 1316,
gaaaaccaggctttccac

SEQ ID NO: 5251 - DNA, 18 bp, Homo Sapiens
  primer_bind 1..18: upstream amplification primer 99-22775 for SEQ 1317,
ccaatcctcactagatac

SEQ ID NO: 5252 - DNA, 18 bp, Homo Sapiens
  primer_bind 1..18: upstream amplification primer 99-2278 for SEQ 1318,
tgctttgatttgaccctg

SEQ ID NO: 5253 - DNA, 18 bp, Homo Sapiens
  primer_bind 1..18: upstream amplification primer 99-22785 for SEQ 1319,
cattcctctgactctttc

SEQ ID NO: 5254 - DNA, 19 bp, Homo Sapiens
  primer_bind 1..19: upstream amplification primer 99-22843 for SEQ 1320,
ctgagcttctttcccaacc

SEQ ID NO: 5255 - DNA, 19 bp, Homo Sapiens
  primer_bind 1..19: upstream amplification primer 99-22844 for SEQ 1321,
aataattttgtgagcccag

SEQ ID NO: 5256 - DNA, 18 bp, Homo Sapiens
  primer_bind 1..18: upstream amplification primer 99-22857 for SEQ 1322,
caatgtcttggtctcttc

SEQ ID NO: 5257 - DNA, 18 bp, Homo Sapiens
  primer_bind 1..18: upstream amplification primer 99-22868 for SEQ 1323,
tccaatcccttctactac

SEQ ID NO: 5258 - DNA, 18 bp, Homo Sapiens
  primer_bind 1..18: upstream amplification primer 99-22872 for SEQ 1324,
acctgtggtgtaaaggtc

SEQ ID NO: 5259 - DNA, 19 bp, Homo Sapiens
  primer_bind 1..19: upstream amplification primer 99-2288 for SEQ 1325,
atgtggtccttgaatgttg

SEQ ID NO: 5260 - DNA, 20 bp, Homo Sapiens
  primer_bind 1..20: upstream amplification primer 99-22917 for SEQ 1326,
gataggtgaagtcattgaag

SEQ ID NO: 5261 - DNA, 19 bp, Homo Sapiens
  primer_bind 1..19: upstream amplification primer 99-22937 for SEQ 1327,
ggatataacaaccaaatgc

SEQ ID NO: 5262 - DNA, 18 bp, Homo Sapiens
  primer_bind 1..18: upstream amplification primer 99-22948 for SEQ 1328,
tttcaagttggctgaggg

SEQ ID NO: 5263 - DNA, 18 bp, Homo Sapiens
  primer_bind 1..18: upstream amplification primer 99-22954 for SEQ 1329,
tggagaaacagagaggac

SEQ ID NO: 5264 - DNA, 19 bp, Homo Sapiens
  primer_bind 1..19: upstream amplification primer 99-22957 for SEQ 1330,
tgtcatcgttttctgttgg

SEQ ID NO: 5265 - DNA, 19 bp, Homo Sapiens
  primer_bind 1..19: upstream amplification primer 99-22959 for SEQ 1331,
tgagagaacatattctgac

SEQ ID NO: 5266 - DNA, 19 bp, Homo Sapiens
  primer_bind 1..19: upstream amplification primer 99-22964 for SEQ 1332,
ataggtcgctcttccagtc

SEQ ID NO: 5267 - DNA, 18 bp, Homo Sapiens
  primer_bind 1..18: upstream amplification primer 99-22975 for SEQ 1333,
tagaagatgggaaggaag

SEQ ID NO: 5268 - DNA, 19 bp, Homo Sapiens
  primer_bind 1..19: upstream amplification primer 99-23014 for SEQ 1334,
tactgacagtggtcatcgc

SEQ ID NO: 5269 - DNA, 18 bp, Homo Sapiens
  primer_bind 1..18: upstream amplification primer 99-23018 for SEQ 1335,
gcagacaaatgacaaagg

SEQ ID NO: 5270 - DNA, 18 bp, Homo Sapiens
  primer_bind 1..18: upstream amplification primer 99-23020 for SEQ 1336,
cctgcattacttctacac

SEQ ID NO: 5271 - DNA, 18 bp, Homo Sapiens
  primer_bind 1..18: upstream amplification primer 99-23083 for SEQ 1337,
acattcctaccctctgac

SEQ ID NO: 5272 - DNA, 18 bp, Homo Sapiens
  primer_bind 1..18: upstream amplification primer 99-23100 for SEQ 1338,
gatgtggagttgtgtgtg

SEQ ID NO: 5273 - DNA, 19 bp, Homo Sapiens
  primer_bind 1..19: upstream amplification primer 99-23115 for SEQ 1339,
gacagcatctcaagtatag

SEQ ID NO: 5274 - DNA, 18 bp, Homo Sapiens
  primer_bind 1..18: upstream amplification primer 99-23118 for SEQ 1340,
tgagtgataagcctctcc

SEQ ID NO: 5275 - DNA, 19 bp, Homo Sapiens
  primer_bind 1..19: upstream amplification primer 99-2312 for SEQ 1341,
gcctatcttgttttgactg

SEQ ID NO: 5276 - DNA, 19 bp, Homo Sapiens
  primer_bind 1..19: upstream amplification primer 99-23123 for SEQ 1342,
ggaacaaggagaaaaagag

SEQ ID NO: 5277 - DNA, 18 bp, Homo Sapiens
  primer_bind 1..18: upstream amplification primer 99-23127 for SEQ 1343,
tgtgaataaggaaggagg

SEQ ID NO: 5278 - DNA, 18 bp, Homo Sapiens
  primer_bind 1..18: upstream amplification primer 99-23132 for SEQ 1344,
caacttgatccagggatg

SEQ ID NO: 5279 - DNA, 18 bp, Homo Sapiens
  primer_bind 1..18: upstream amplification primer 99-23134 for SEQ 1345,
tgggttagggacagtatg

SEQ ID NO: 5280 - DNA, 19 bp, Homo Sapiens
  primer_bind 1..19: upstream amplification primer 99-2315 for SEQ 1346,
ttcagagcaacaattttgg

SEQ ID NO: 5281 - DNA, 19 bp, Homo Sapiens
  primer_bind 1..19: upstream amplification primer 99-23150 for SEQ 1347,
caaaagccaacaatcagcc

SEQ ID NO: 5282 - DNA, 20 bp, Homo Sapiens
  primer_bind 1..20: upstream amplification primer 99-2320 for SEQ 1348,
ccaagtttatgagattagag

SEQ ID NO: 5283 - DNA, 18 bp, Homo Sapiens
  primer_bind 1..18: upstream amplification primer 99-23201 for SEQ 1349,
cagagggaaaatggcaac

SEQ ID NO: 5284 - DNA, 21 bp, Homo Sapiens
  primer_bind 1..21: upstream amplification primer 99-23202 for SEQ 1350,
caattaccattagcaaatcag

SEQ ID NO: 5285 - DNA, 19 bp, Homo Sapiens
  primer_bind 1..19: upstream amplification primer 99-23204 for SEQ 1351,
ggaaaatgtccagtcacac

SEQ ID NO: 5286 - DNA, 20 bp, Homo Sapiens
  primer_bind 1..20: upstream amplification primer 99-23207 for SEQ 1352,
gaaagaagttgaaagaagcc

SEQ ID NO: 5287 - DNA, 19 bp, Homo Sapiens
  primer_bind 1..19: upstream amplification primer 99-2321 for SEQ 1353,
ctaacctagatgatcttcc

SEQ ID NO: 5288 - DNA, 18 bp, Homo Sapiens
  primer_bind 1..18: upstream amplification primer 99-23228 for SEQ 1354,
gccagtgagaaatacaag

SEQ ID NO: 5289 - DNA, 18 bp, Homo Sapiens
  primer_bind 1..18: upstream amplification primer 99-2324 for SEQ 1355,
tgtcccaagtttagttcc

SEQ ID NO: 5290 - DNA, 20 bp, Homo Sapiens
  primer_bind 1..20: upstream amplification primer 99-23266 for SEQ 1356,
gcaaatagacaaatctcacc

SEQ ID NO: 5291 - DNA, 18 bp, Homo Sapiens
  primer_bind 1..18: upstream amplification primer 99-23269 for SEQ 1357,
gtggcatctatttgactg

SEQ ID NO: 5292 - DNA, 18 bp, Homo Sapiens
  primer_bind 1..18: upstream amplification primer 99-2328 for SEQ 1358,
tctgttgctgggaatttc

SEQ ID NO: 5293 - DNA, 19 bp, Homo Sapiens
  primer_bind 1..19: upstream amplification primer 99-23299 for SEQ 1359,
gccatcctgttaagaaaag

SEQ ID NO: 5294 - DNA, 18 bp, Homo Sapiens
  primer_bind 1..18: upstream amplification primer 99-23302 for SEQ 1360,
gagatgaggaaggagaag

SEQ ID NO: 5295 - DNA, 19 bp, Homo Sapiens
  primer_bind 1..19: upstream amplification primer 99-2331 for SEQ 1361,
ttatgtgcctctcagtgcc

SEQ ID NO: 5296 - DNA, 20 bp, Homo Sapiens
  primer_bind 1..20: upstream amplification primer 99-23312 for SEQ 1362,
cacactaacttcttagcatc

SEQ ID NO: 5297 - DNA, 18 bp, Homo Sapiens
  primer_bind 1..18: upstream amplification primer 99-23317 for SEQ 1363,
tgtttccattctctcctc

SEQ ID NO: 5298 - DNA, 18 bp, Homo Sapiens
  primer_bind 1..18: upstream amplification primer 99-23322 for SEQ 1364,
tccagtgtctcttcttag

SEQ ID NO: 5299 - DNA, 20 bp, Homo Sapiens
  primer_bind 1..20: upstream amplification primer 99-23326 for SEQ 1365,
tgtcatggcaatggggatgg

SEQ ID NO: 5300 - DNA, 18 bp, Homo Sapiens
  primer_bind 1..18: upstream amplification primer 99-23328 for SEQ 1366,
tttgcatttgctctggtg

SEQ ID NO: 5301 - DNA, 18 bp, Homo Sapiens
  primer_bind 1..18: upstream amplification primer 99-23333 for SEQ 1367,
aaggatttgttggggtgg

SEQ ID NO: 5302 - DNA, 19 bp, Homo Sapiens
  primer_bind 1..19: upstream amplification primer 99-23334 for SEQ 1368,
acttcccattctttactac

SEQ ID NO: 5303 - DNA, 18 bp, Homo Sapiens
  primer_bind 1..18: upstream amplification primer 99-23359 for SEQ 1369,
agctctgtcttcagtttc

SEQ ID NO: 5304 - DNA, 18 bp, Homo Sapiens
  primer_bind 1..18: upstream amplification primer 99-23381 for SEQ 1370,
ttaacagtggaggagaag

SEQ ID NO: 5305 - DNA, 18 bp, Homo Sapiens
  primer_bind 1..18: upstream amplification primer 99-23387 for SEQ 1371,
tagcacactctgtatctg

SEQ ID NO: 5306 - DNA, 18 bp, Homo Sapiens
  primer_bind 1..18: upstream amplification primer 99-23413 for SEQ 1372,
ccagatggacgattacag

SEQ ID NO: 5307 - DNA, 19 bp, Homo Sapiens
  primer_bind 1..19: upstream amplification primer 99-23415 for SEQ 1373,
gtatggacatagaaaatgg

SEQ ID NO: 5308 - DNA, 20 bp, Homo Sapiens
  primer_bind 1..20: upstream amplification primer 99-23417 for SEQ 1374,
gcttgaaaagctagtatgtg

SEQ ID NO: 5309 - DNA, 20 bp, Homo Sapiens
  primer_bind 1..20: upstream amplification primer 99-23437 for SEQ 1375,
cccatttcaatcttagatag

SEQ ID NO: 5310 - DNA, 21 bp, Homo Sapiens
  primer_bind 1..21: upstream amplification primer 99-23440 for SEQ 1376,
gtggcttttttccagtaaagg

SEQ ID NO: 5311 - DNA, 19 bp, Homo Sapiens
  primer_bind 1..19: upstream amplification primer 99-23444 for SEQ 1377,
cttcatagtcaacgaaggc

SEQ ID NO: 5312 - DNA, 18 bp, Homo Sapiens
  primer_bind 1..18: upstream amplification primer 99-2345 for SEQ 1378,
cactctccatttccatcc

SEQ ID NO: 5313 - DNA, 20 bp, Homo Sapiens
  primer_bind 1..20: upstream amplification primer 99-23451 for SEQ 1379,
ggatatgtaaattgcccccc

SEQ ID NO: 5314 - DNA, 20 bp, Homo Sapiens
  primer_bind 1..20: upstream amplification primer 99-23452 for SEQ 1380,
tcctctcccaattctcaccc

SEQ ID NO: 5315 - DNA, 20 bp, Homo Sapiens
  primer_bind 1..20: upstream amplification primer 99-23454 for SEQ 1381,
tcaaggcattttccaagttg

SEQ ID NO: 5316 - DNA, 19 bp, Homo Sapiens
  primer_bind 1..19: upstream amplification primer 99-23460 for SEQ 1382,
agtgacttgtgccatgtcc

SEQ ID NO: 5317 - DNA, 20 bp, Homo Sapiens
  primer_bind 1..20: upstream amplification primer 99-23462 for SEQ 1383,
ggtaaagttccattttcatc

SEQ ID NO: 5318 - DNA, 18 bp, Homo Sapiens
  primer_bind 1..18: upstream amplification primer 99-23463 for SEQ 1384,
ttggcttcacctgttacg

SEQ ID NO: 5319 - DNA, 18 bp, Homo Sapiens
  primer_bind 1..18: upstream amplification primer 99-23469 for SEQ 1385,
tgttcattctaccactcc

SEQ ID NO: 5320 - DNA, 20 bp, Homo Sapiens
  primer_bind 1..20: upstream amplification primer 99-2347 for SEQ 1386,
gttaagaagtaagaggaatg

SEQ ID NO: 5321 - DNA, 19 bp, Homo Sapiens
  primer_bind 1..19: upstream amplification primer 99-23473 for SEQ 1387,
aggatatgctgacaacggg

SEQ ID NO: 5322 - DNA, 19 bp, Homo Sapiens
  primer_bind 1..19: upstream amplification primer 99-2348 for SEQ 1388,
gcccattaccatattagac

SEQ ID NO: 5323 - DNA, 20 bp, Homo Sapiens
  primer_bind 1..20: upstream amplification primer 99-23488 for SEQ 1389,
cagaagagagtcaaattaag

SEQ ID NO: 5324 - DNA, 19 bp, Homo Sapiens
  primer_bind 1..19: upstream amplification primer 99-23492 for SEQ 1390,
catctttgtttcaatgagg

SEQ ID NO: 5325 - DNA, 18 bp, Homo Sapiens
  primer_bind 1..18: upstream amplification primer 99-23496 for SEQ 1391,
gataagcctgtctgattg

SEQ ID NO: 5326 - DNA, 18 bp, Homo Sapiens
  primer_bind 1..18: upstream amplification primer 99-23510 for SEQ 1392,
ggagaaaggacgtgttag

SEQ ID NO: 5327 - DNA, 18 bp, Homo Sapiens
  primer_bind 1..18: upstream amplification primer 99-23528 for SEQ 1393,
aatagagtgacctgtgcc

SEQ ID NO: 5328 - DNA, 19 bp, Homo Sapiens
  primer_bind 1..19: upstream amplification primer 99-2356 for SEQ 1394,
gtgcctataatcacacttg

SEQ ID NO: 5329 - DNA, 19 bp, Homo Sapiens
  primer_bind 1..19: upstream amplification primer 99-2362 for SEQ 1395,
tacagcaatggtataaagc

SEQ ID NO: 5330 - DNA, 20 bp, Homo Sapiens
  primer_bind 1..20: upstream amplification primer 99-2364 for SEQ 1396,
ttatccatcatttagaaggc

SEQ ID NO: 5331 - DNA, 18 bp, Homo Sapiens
  primer_bind 1..18: upstream amplification primer 99-2367 for SEQ 1397,
cactggagatagctgaac

SEQ ID NO: 5332 - DNA, 18 bp, Homo Sapiens
  primer_bind 1..18: upstream amplification primer 99-2368 for SEQ 1398,
cactttccccactaccac

SEQ ID NO: 5333 - DNA, 20 bp, Homo Sapiens
  primer_bind 1..20: upstream amplification primer 99-23687 for SEQ 1399,
gatgaaaacacgaagaatag

SEQ ID NO: 5334 - DNA, 18 bp, Homo Sapiens
  primer_bind 1..18: upstream amplification primer 99-237 for SEQ 1400,
ctacaattcacctctgac

SEQ ID NO: 5335 - DNA, 20 bp, Homo Sapiens
  primer_bind 1..20: upstream amplification primer 99-23714 for SEQ 1401,
ctctgcttttcaatattctc

SEQ ID NO: 5336 - DNA, 20 bp, Homo Sapiens
  primer_bind 1..20: upstream amplification primer 99-23737 for SEQ 1402,
tctctccaaatcccttcccc

SEQ ID NO: 5337 - DNA, 20 bp, Homo Sapiens
  primer_bind 1..20: upstream amplification primer 99-2375 for SEQ 1403,
cattcagataaaagggaaac

SEQ ID NO: 5338 - DNA, 19 bp, Homo Sapiens
  primer_bind 1..19: upstream amplification primer 99-23773 for SEQ 1404,
atcctgctgtggacctttg

SEQ ID NO: 5339 - DNA, 18 bp, Homo Sapiens
  primer_bind 1..18: upstream amplification primer 99-2378 for SEQ 1405,
cgggcataaaaatgcagg

SEQ ID NO: 5340 - DNA, 20 bp, Homo Sapiens
  primer_bind 1..20: upstream amplification primer 99-2381 for SEQ 1406,
gtatatgtgaaggttgtggg

SEQ ID NO: 5341 - DNA, 18 bp, Homo Sapiens
  primer_bind 1..18: upstream amplification primer 99-2409 for SEQ 1407,
cttgccgtacttcttctg

SEQ ID NO: 5342 - DNA, 19 bp, Homo Sapiens
  primer_bind 1..19: upstream amplification primer 99-241 for SEQ 1408,
tgactctgtttatgaactg

SEQ ID NO: 5343 - DNA, 19 bp, Homo Sapiens
  primer_bind 1..19: upstream amplification primer 99-2413 for SEQ 1409,
gtaagatgtgacttgctcc

SEQ ID NO: 5344 - DNA, 19 bp, Homo Sapiens
  primer_bind 1..19: upstream amplification primer 99-2417 for SEQ 1410,
taccgagttgatatgtatg

SEQ ID NO: 5345 - DNA, 20 bp, Homo Sapiens
  primer_bind 1..20: upstream amplification primer 99-2419 for SEQ 1411,
ccagcttgaattttggtgag

SEQ ID NO: 5346 - DNA, 19 bp, Homo Sapiens
  primer_bind 1..19: upstream amplification primer 99-24246 for SEQ 1412,
cacactctcaattttccac

SEQ ID NO: 5347 - DNA, 20 bp, Homo Sapiens
  primer_bind 1..20: upstream amplification primer 99-24253 for SEQ 1413,
gttgcttttgctttgtcttg

SEQ ID NO: 5348 - DNA, 18 bp, Homo Sapiens
  primer_bind 1..18: upstream amplification primer 99-24259 for SEQ 1414,
gatgctgggaaataatgg

SEQ ID NO: 5349 - DNA, 18 bp, Homo Sapiens
  primer_bind 1..18: upstream amplification primer 99-24264 for SEQ 1415,
gaatgtagatgctgctcc

SEQ ID NO: 5350 - DNA, 19 bp, Homo Sapiens
  primer_bind 1..19: upstream amplification primer 99-24269 for SEQ 1416,
ttgtatctactggtgtaac

SEQ ID NO: 5351 - DNA, 18 bp, Homo Sapiens
  primer_bind 1..18: upstream amplification primer 99-24270 for SEQ 1417,
caaaacccaccatttcag

SEQ ID NO: 5352 - DNA, 18 bp, Homo Sapiens
  primer_bind 1..18: upstream amplification primer 99-24275 for SEQ 1418,
tcaggaaacctgctttac

SEQ ID NO: 5353 - DNA, 19 bp, Homo Sapiens
  primer_bind 1..19: upstream amplification primer 99-24284 for SEQ 1419,
aaagtgttgctcaaaagac

SEQ ID NO: 5354 - DNA, 21 bp, Homo Sapiens
  primer_bind 1..21: upstream amplification primer 99-24286 for SEQ 1420,
tatttttgagggcattatcag

SEQ ID NO: 5355 - DNA, 18 bp, Homo Sapiens
  primer_bind 1..18: upstream amplification primer 99-24288 for SEQ 1421,
gctgttctcgcatgtatc

SEQ ID NO: 5356 - DNA, 18 bp, Homo Sapiens
  primer_bind 1..18: upstream amplification primer 99-24333 for SEQ 1422,
ttctccctgttttcttcc

SEQ ID NO: 5357 - DNA, 20 bp, Homo Sapiens
  primer_bind 1..20: upstream amplification primer 99-24342 for SEQ 1423,
caatggtgggaatgcaaaac

SEQ ID NO: 5358 - DNA, 20 bp, Homo Sapiens
  primer_bind 1..20: upstream amplification primer 99-24376 for SEQ 1424,
cattagattgaaaaccagtg

SEQ ID NO: 5359 - DNA, 18 bp, Homo Sapiens
  primer_bind 1..18: upstream amplification primer 99-24379 for SEQ 1425,
ttattctgtgatgccgtg

SEQ ID NO: 5360 - DNA, 18 bp, Homo Sapiens
  primer_bind 1..18: upstream amplification primer 99-24381 for SEQ 1426,
gccatgtgaacgcacagc

SEQ ID NO: 5361 - DNA, 20 bp, Homo Sapiens
  primer_bind 1..20: upstream amplification primer 99-24385 for SEQ 1427,
ctcacacaatagtaaaactc

SEQ ID NO: 5362 - DNA, 19 bp, Homo Sapiens
  primer_bind 1..19: upstream amplification primer 99-24388 for SEQ 1428,
ccttcaacatttatctcac

SEQ ID NO: 5363 - DNA, 19 bp, Homo Sapiens
  primer_bind 1..19: upstream amplification primer 99-24390 for SEQ 1429,
tttcccagcagaatggcac

SEQ ID NO: 5364 - DNA, 20 bp, Homo Sapiens
  primer_bind 1..20: upstream amplification primer 99-24392 for SEQ 1430,
acttccagcctccttaccac

SEQ ID NO: 5365 - DNA, 18 bp, Homo Sapiens
  primer_bind 1..18: upstream amplification primer 99-24393 for SEQ 1431,
taggagcagaggggcttg

SEQ ID NO: 5366 - DNA, 19 bp, Homo Sapiens
  primer_bind 1..19: upstream amplification primer 99-2440 for SEQ 1432,
caataagtacaccagtttc

SEQ ID NO: 5367 - DNA, 19 bp, Homo Sapiens
  primer_bind 1..19: upstream amplification primer 99-24409 for SEQ 1433,
tgcatctctcttaggtgcc

SEQ ID NO: 5368 - DNA, 20 bp, Homo Sapiens
  primer_bind 1..20: upstream amplification primer 99-24411 for SEQ 1434,
gtcaagtattaggcattcag

SEQ ID NO: 5369 - DNA, 18 bp, Homo Sapiens
  primer_bind 1..18: upstream amplification primer 99-24427 for SEQ 1435,
agtgtcaaatccaaaggc

SEQ ID NO: 5370 - DNA, 18 bp, Homo Sapiens
  primer_bind 1..18: upstream amplification primer 99-24432 for SEQ 1436,
cctgaagtgtatgagtcc

SEQ ID NO: 5371 - DNA, 18 bp, Homo Sapiens
  primer_bind 1..18: upstream amplification primer 99-24438 for SEQ 1437,
ctgtggactcttactttg

SEQ ID NO: 5372 - DNA, 18 bp, Homo Sapiens
  primer_bind 1..18: upstream amplification primer 99-24441 for SEQ 1438,
agacaatctctatgcagg

SEQ ID NO: 5373 - DNA, 18 bp, Homo Sapiens
  primer_bind 1..18: upstream amplification primer 99-24447 for SEQ 1439,
gaaggtagttgaaaaggg

SEQ ID NO: 5374 - DNA, 18 bp, Homo Sapiens
  primer_bind 1..18: upstream amplification primer 99-2445 for SEQ 1440,
agagacttgttcccacac

SEQ ID NO: 5375 - DNA, 20 bp, Homo Sapiens
  primer_bind 1..20: upstream amplification primer 99-24454 for SEQ 1441,
gggacttaacaattctaaac

SEQ ID NO: 5376 - DNA, 18 bp, Homo Sapiens
  primer_bind 1..18: upstream amplification primer 99-24463 for SEQ 1442,
tgactcctaacaaacccc

SEQ ID NO: 5377 - DNA, 19 bp, Homo Sapiens
  primer_bind 1..19: upstream amplification primer 99-24496 for SEQ 1443,
ctcagggcttactggttag

SEQ ID NO: 5378 - DNA, 18 bp, Homo Sapiens
  primer_bind 1..18: upstream amplification primer 99-24506 for SEQ 1444,
tcaccgataacagcttcc

SEQ ID NO: 5379 - DNA, 18 bp, Homo Sapiens
  primer_bind 1..18: upstream amplification primer 99-24508 for SEQ 1445,
ctgaaagcagtgaatgcc

SEQ ID NO: 5380 - DNA, 19 bp, Homo Sapiens
  primer_bind 1..19: upstream amplification primer 99-24529 for SEQ 1446,
acttctcattccccatcac

SEQ ID NO: 5381 - DNA, 18 bp, Homo Sapiens
  primer_bind 1..18: upstream amplification primer 99-24534 for SEQ 1447,
aacggtgggaacaacaag

SEQ ID NO: 5382 - DNA, 18 bp, Homo Sapiens
  primer_bind 1..18: upstream amplification primer 99-24554 for SEQ 1448,
caagttggtgccagtttc

SEQ ID NO: 5383 - DNA, 20 bp, Homo Sapiens
  primer_bind 1..20: upstream amplification primer 99-24557 for SEQ 1449,
cctcctccatcaaatagtag

SEQ ID NO: 5384 - DNA, 20 bp, Homo Sapiens
  primer_bind 1..20: upstream amplification primer 99-24561 for SEQ 1450,
ccaaatgtttgtagcctatg

SEQ ID NO: 5385 - DNA, 20 bp, Homo Sapiens
  primer_bind 1..20: upstream amplification primer 99-24570 for SEQ 1451,
ctttctaggaaactctactg

SEQ ID NO: 5386 - DNA, 18 bp, Homo Sapiens
  primer_bind 1..18: upstream amplification primer 99-24688 for SEQ 1452,
gccatccaacaaatgctc

SEQ ID NO: 5387 - DNA, 18 bp, Homo Sapiens
  primer_bind 1..18: upstream amplification primer 99-24725 for SEQ 1453,
atgagtaggtaagtcagg

SEQ ID NO: 5388 - DNA, 18 bp, Homo Sapiens
  primer_bind 1..18: upstream amplification primer 99-24727 for SEQ 1454,
ttggtggcaggatgtttc

SEQ ID NO: 5389 - DNA, 18 bp, Homo Sapiens
  primer_bind 1..18: upstream amplification primer 99-24750 for SEQ 1455,
tagtggaagaggacaaag

SEQ ID NO: 5390 - DNA, 18 bp, Homo Sapiens
  primer_bind 1..18: upstream amplification primer 99-24778 for SEQ 1456,
catccccagttgtttttg

SEQ ID NO: 5391 - DNA, 18 bp, Homo Sapiens
  primer_bind 1..18: upstream amplification primer 99-24793 for SEQ 1457,
agatagtggggaatcagg

SEQ ID NO: 5392 - DNA, 19 bp, Homo Sapiens
  primer_bind 1..19: upstream amplification primer 99-24800 for SEQ 1458,
gaagaactaagactacctg

SEQ ID NO: 5393 - DNA, 20 bp, Homo Sapiens
  primer_bind 1..20: upstream amplification primer 99-25005 for SEQ 1459,
cagttagaaatagaggcaag

SEQ ID NO: 5394 - DNA, 18 bp, Homo Sapiens
  primer_bind 1..18: upstream amplification primer 99-25007 for SEQ 1460,
agatggttctctgaggtc

SEQ ID NO: 5395 - DNA, 19 bp, Homo Sapiens
  primer_bind 1..19: upstream amplification primer 99-25053 for SEQ 1461,
gatttgtttgcagctagag

SEQ ID NO: 5396 - DNA, 19 bp, Homo Sapiens
  primer_bind 1..19: upstream amplification primer 99-25055 for SEQ 1462,
gaaattatctaaaggggtg

SEQ ID NO: 5397 - DNA, 18 bp, Homo Sapiens
  primer_bind 1..18: upstream amplification primer 99-25070 for SEQ 1463,
tcacattccacagatgag

SEQ ID NO: 5398 - DNA, 18 bp, Homo Sapiens
  primer_bind 1..18: upstream amplification primer 99-25077 for SEQ 1464,
cccagcaacttctgtatc

SEQ ID NO: 5399 - DNA, 19 bp, Homo Sapiens
  primer_bind 1..19: upstream amplification primer 99-25129 for SEQ 1465,
aaagcaaaagcattttcgg

SEQ ID NO: 5400 - DNA, 21 bp, Homo Sapiens
  primer_bind 1..21: upstream amplification primer 99-25134 for SEQ 1466,
attccccaggattccccatac

SEQ ID NO: 5401 - DNA, 19 bp, Homo Sapiens
  primer_bind 1..19: upstream amplification primer 99-2524 for SEQ 1467,
tcacatctggcttctccac

SEQ ID NO: 5402 - DNA, 19 bp, Homo Sapiens
  primer_bind 1..19: upstream amplification primer 99-25246 for SEQ 1468,
caggtgacatccaagcatc

SEQ ID NO: 5403 - DNA, 18 bp, Homo Sapiens
  primer_bind 1..18: upstream amplification primer 99-25249 for SEQ 1469,
gtgtactagaagcctgtc

SEQ ID NO: 5404 - DNA, 18 bp, Homo Sapiens
  primer_bind 1..18: upstream amplification primer 99-2525 for SEQ 1470,
gtgaaactggactgtatg

SEQ ID NO: 5405 - DNA, 18 bp, Homo Sapiens
  primer_bind 1..18: upstream amplification primer 99-25255 for SEQ 1471,
agagttttcaaagtgggg

SEQ ID NO: 5406 - DNA, 20 bp, Homo Sapiens
  primer_bind 1..20: upstream amplification primer 99-25369 for SEQ 1472,
gatttgacagattccaactc

SEQ ID NO: 5407 - DNA, 19 bp, Homo Sapiens
  primer_bind 1..19: upstream amplification primer 99-25379 for SEQ 1473,
agctaatgggataagatac

SEQ ID NO: 5408 - DNA, 18 bp, Homo Sapiens
  primer_bind 1..18: upstream amplification primer 99-25382 for SEQ 1474,
tcgatgcaatgcgaaaac

SEQ ID NO: 5409 - DNA, 19 bp, Homo Sapiens
  primer_bind 1..19: upstream amplification primer 99-25387 for SEQ 1475,
tcctcttccctctgacttg

SEQ ID NO: 5410 - DNA, 18 bp, Homo Sapiens
  primer_bind 1..18: upstream amplification primer 99-25400 for SEQ 1476,
tgagtctgtctttgcacc

SEQ ID NO: 5411 - DNA, 18 bp, Homo Sapiens
  primer_bind 1..18: upstream amplification primer 99-25412 for SEQ 1477,
ggtaaggtggtatggtag

SEQ ID NO: 5412 - DNA, 19 bp, Homo Sapiens
  primer_bind 1..19: upstream amplification primer 99-25431 for SEQ 1478,
gagttaatcaagtagatgg

SEQ ID NO: 5413 - DNA, 18 bp, Homo Sapiens
  primer_bind 1..18: upstream amplification primer 99-25432 for SEQ 1479,
gacagaaagtgtggttcc

SEQ ID NO: 5414 - DNA, 18 bp, Homo Sapiens
  primer_bind 1..18: upstream amplification primer 99-25433 for SEQ 1480,
ttctctgagagctagacc

SEQ ID NO: 5415 - DNA, 18 bp, Homo Sapiens
  primer_bind 1..18: upstream amplification primer 99-25447 for SEQ 1481,
accactctcgtggggatg

SEQ ID NO: 5416 - DNA, 18 bp, Homo Sapiens
  primer_bind 1..18: upstream amplification primer 99-25448 for SEQ 1482,
ctgattagacctgactcg

SEQ ID NO: 5417 - DNA, 18 bp, Homo Sapiens
  primer_bind 1..18: upstream amplification primer 99-25452 for SEQ 1483,
agctaaattgcacagctc

SEQ ID NO: 5418 - DNA, 18 bp, Homo Sapiens
  primer_bind 1..18: upstream amplification primer 99-25454 for SEQ 1484,
gaaaatgggagatggcac

SEQ ID NO: 5419 - DNA, 18 bp, Homo Sapiens
  primer_bind 1..18: upstream amplification primer 99-25458 for SEQ 1485,
gtcatcaagcggttactg

SEQ ID NO: 5420 - DNA, 18 bp, Homo Sapiens
  primer_bind 1..18: upstream amplification primer 99-25503 for SEQ 1486,
gacatgagaactaagacg

SEQ ID NO: 5421 - DNA, 19 bp, Homo Sapiens
  primer_bind 1..19: upstream amplification primer 99-25507 for SEQ 1487,
ctattaaatgcctggtctg

SEQ ID NO: 5422 - DNA, 18 bp, Homo Sapiens
  primer_bind 1..18: upstream amplification primer 99-25510 for SEQ 1488,
gcattaaacgcttctgtc

SEQ ID NO: 5423 - DNA, 18 bp, Homo Sapiens
  primer_bind 1..18: upstream amplification primer 99-25538 for SEQ 1489,
tctgtcaacctcatcatc

SEQ ID NO: 5424 - DNA, 18 bp, Homo Sapiens
  primer_bind 1..18: upstream amplification primer 99-25539 for SEQ 1490,
agctgacctttaagatgc

SEQ ID NO: 5425 - DNA, 19 bp, Homo Sapiens
  primer_bind 1..19: upstream amplification primer 99-25543 for SEQ 1491,
atcatacatacgctttccc

SEQ ID NO: 5426 - DNA, 19 bp, Homo Sapiens
  primer_bind 1..19: upstream amplification primer 99-25575 for SEQ 1492,
cgagaatgtaaattctgcc

SEQ ID NO: 5427 - DNA, 18 bp, Homo Sapiens
  primer_bind 1..18: upstream amplification primer 99-25618 for SEQ 1493,
gggataaagacaagcaac

SEQ ID NO: 5428 - DNA, 19 bp, Homo Sapiens
  primer_bind 1..19: upstream amplification primer 99-25620 for SEQ 1494,
tcccattaaatgttgctac

SEQ ID NO: 5429 - DNA, 20 bp, Homo Sapiens
  primer_bind 1..20: upstream amplification primer 99-25629 for SEQ 1495,
ggatttgaggctatctaaac

SEQ ID NO: 5430 - DNA, 18 bp, Homo Sapiens
  primer_bind 1..18: upstream amplification primer 99-25657 for SEQ 1496,
aaagctactacccttctg

SEQ ID NO: 5431 - DNA, 20 bp, Homo Sapiens
  primer_bind 1..20: upstream amplification primer 99-25672 for SEQ 1497,
ctatcttatcgttaggaatg

SEQ ID NO: 5432 - DNA, 19 bp, Homo Sapiens
  primer_bind 1..19: upstream amplification primer 99-25676 for SEQ 1498,
cagaatgtgagtagatgtg

SEQ ID NO: 5433 - DNA, 20 bp, Homo Sapiens
  primer_bind 1..20: upstream amplification primer 99-25678 for SEQ 1499,
gaattgtttgtctttatgcc

SEQ ID NO: 5434 - DNA, 19 bp, Homo Sapiens
  primer_bind 1..19: upstream amplification primer 99-2570 for SEQ 1500,
gtttgtcttggctattaag

SEQ ID NO: 5435 - DNA, 20 bp, Homo Sapiens
  primer_bind 1..20: upstream amplification primer 99-25712 for SEQ 1501,
ttaaaaggaggggttggggg

SEQ ID NO: 5436 - DNA, 18 bp, Homo Sapiens
  primer_bind 1..18: upstream amplification primer 99-25716 for SEQ 1502,
taactgacaccttcactg

SEQ ID NO: 5437 - DNA, 19 bp, Homo Sapiens
  primer_bind 1..19: upstream amplification primer 99-25717 for SEQ 1503,
gaaaatggagaatgaggac

SEQ ID NO: 5438 - DNA, 21 bp, Homo Sapiens
  primer_bind 1..21: upstream amplification primer 99-25725 for SEQ 1504,
gaatacatagcataattctgg

SEQ ID NO: 5439 - DNA, 20 bp, Homo Sapiens
  primer_bind 1..20: upstream amplification primer 99-25732 for SEQ 1505,
cacaaactaatttgtagcac

SEQ ID NO: 5440 - DNA, 18 bp, Homo Sapiens
  primer_bind 1..18: upstream amplification primer 99-25745 for SEQ 1506,
tggtccacagatcagaag

SEQ ID NO: 5441 - DNA, 18 bp, Homo Sapiens
  primer_bind 1..18: upstream amplification primer 99-25781 for SEQ 1507,
cacccaatttagccaaag

SEQ ID NO: 5442 - DNA, 19 bp, Homo Sapiens
  primer_bind 1..19: upstream amplification primer 99-25836 for SEQ 1508,
atgtaaggaatggattgag

SEQ ID NO: 5443 - DNA, 18 bp, Homo Sapiens
  primer_bind 1..18: upstream amplification primer 99-2597 for SEQ 1509,
aaaccgactagaagccac

SEQ ID NO: 5444 - DNA, 21 bp, Homo Sapiens
  primer_bind 1..21: upstream amplification primer 99-26001 for SEQ 1510,
gtttagttttctattctgtcc

SEQ ID NO: 5445 - DNA, 18 bp, Homo Sapiens
  primer_bind 1..18: upstream amplification primer 99-26002 for SEQ 1511,
agacagatcagactctgg

SEQ ID NO: 5446 - DNA, 19 bp, Homo Sapiens
  primer_bind 1..19: upstream amplification primer 99-26042 for SEQ 1512,
ttcagtttggcacattttc

SEQ ID NO: 5447 - DNA, 19 bp, Homo Sapiens
  primer_bind 1..19: upstream amplification primer 99-26080 for SEQ 1513,
gctcctgataaaattactg

SEQ ID NO: 5448 - DNA, 19 bp, Homo Sapiens
  primer_bind 1..19: upstream amplification primer 99-26082 for SEQ 1514,
ctgggtcatttaagatgtc

SEQ ID NO: 5449 - DNA, 19 bp, Homo Sapiens
  primer_bind 1..19: upstream amplification primer 99-26099 for SEQ 1515,
tttgggtatatttgcactg

SEQ ID NO: 5450 - DNA, 19 bp, Homo Sapiens
  primer_bind 1..19: upstream amplification primer 99-2610 for SEQ 1516,
atatcagggcaggcacaag

SEQ ID NO: 5451 - DNA, 18 bp, Homo Sapiens
  primer_bind 1..18: upstream amplification primer 99-26105 for SEQ 1517,
tggaagcaggtatattgg

SEQ ID NO: 5452 - DNA, 19 bp, Homo Sapiens
  primer_bind 1..19: upstream amplification primer 99-26116 for SEQ 1518,
cacttttaggatcatctac

SEQ ID NO: 5453 - DNA, 18 bp, Homo Sapiens
  primer_bind 1..18: upstream amplification primer 99-2615 for SEQ 1519,
ggaagagggcaactttac

SEQ ID NO: 5454 - DNA, 18 bp, Homo Sapiens
  primer_bind 1..18: upstream amplification primer 99-2620 for SEQ 1520,
tgaaatgggctgtagatg

SEQ ID NO: 5455 - DNA, 18 bp, Homo Sapiens
  primer_bind 1..18: upstream amplification primer 99-2624 for SEQ 1521,
ttaaaccttggcttcctg

SEQ ID NO: 5456 - DNA, 18 bp, Homo Sapiens
  primer_bind 1..18: upstream amplification primer 99-2625 for SEQ 1522,
ttcaaccttttgtcgctg

SEQ ID NO: 5457 - DNA, 18 bp, Homo Sapiens
  primer_bind 1..18: upstream amplification primer 99-2637 for SEQ 1523,
ctaccatcactttcctcc

SEQ ID NO: 5458 - DNA, 19 bp, Homo Sapiens
  primer_bind 1..19: upstream amplification primer 99-2662 for SEQ 1524,
tgtggggagtcagaaaagg

SEQ ID NO: 5459 - DNA, 19 bp, Homo Sapiens
  primer_bind 1..19: upstream amplification primer 99-2669 for SEQ 1525,
gaataaagtttactggagg

SEQ ID NO: 5460 - DNA, 21 bp, Homo Sapiens
  primer_bind 1..21: upstream amplification primer 99-2675 for SEQ 1526,
gattttatactccagtattcc

SEQ ID NO: 5461 - DNA, 19 bp, Homo Sapiens
  primer_bind 1..19: upstream amplification primer 99-2683 for SEQ 1527,
tgaagcataagagggggag

SEQ ID NO: 5462 - DNA, 18 bp, Homo Sapiens
  primer_bind 1..18: upstream amplification primer 99-342 for SEQ 1528,
gcatttattccaagtgcc

SEQ ID NO: 5463 - DNA, 19 bp, Homo Sapiens
  primer_bind 1..19: upstream amplification primer 99-370 for SEQ 1529,
ctctacagctatggtaatc

SEQ ID NO: 5464 - DNA, 18 bp, Homo Sapiens
  primer_bind 1..18: upstream amplification primer 99-371 for SEQ 1530,
atttgaggagcccagacc

SEQ ID NO: 5465 - DNA, 18 bp, Homo Sapiens
  primer_bind 1..18: upstream amplification primer 99-388 for SEQ 1531,
ctcctcttacagtcttcc

SEQ ID NO: 5466 - DNA, 18 bp, Homo Sapiens
  primer_bind 1..18: upstream amplification primer 99-390 for SEQ 1532,
ggcttacaagaacaatgg

SEQ ID NO: 5467 - DNA, 21 bp, Homo Sapiens
  primer_bind 1..21: upstream amplification primer 99-393 for SEQ 1533,
ggattgagaatataacacaag

SEQ ID NO: 5468 - DNA, 19 bp, Homo Sapiens
  primer_bind 1..19: upstream amplification primer 99-397 for SEQ 1534,
ctctacagctatggtaatc

SEQ ID NO: 5469 - DNA, 19 bp, Homo Sapiens
  primer_bind 1..19: upstream amplification primer 99-400 for SEQ 1535,
gtcattaaccagtcgtatg

SEQ ID NO: 5470 - DNA, 21 bp, Homo Sapiens
  primer_bind 1..21: upstream amplification primer 99-402 for SEQ 1536,
cagaaagcccaggaatctaac

SEQ ID NO: 5471 - DNA, 18 bp, Homo Sapiens
  primer_bind 1..18: upstream amplification primer 99-404 for SEQ 1537,
tgccagggagtttgtttc

SEQ ID NO: 5472 - DNA, 19 bp, Homo Sapiens
  primer_bind 1..19: upstream amplification primer 99-414 for SEQ 1538,
gacacacttaactgaatcc

SEQ ID NO: 5473 - DNA, 20 bp, Homo Sapiens
  primer_bind 1..20: upstream amplification primer 99-417 for SEQ 1539,
catcaatctttaatgaggac

SEQ ID NO: 5474 - DNA, 18 bp, Homo Sapiens
  primer_bind 1..18: upstream amplification primer 99-426 for SEQ 1540,
ttgtaaatggaaggctgg

SEQ ID NO: 5475 - DNA, 21 bp, Homo Sapiens
  primer_bind 1..21: upstream amplification primer 99-429 for SEQ 1541,
ctggaagttaaattctaacgg

SEQ ID NO: 5476 - DNA, 18 bp, Homo Sapiens
  primer_bind 1..18: upstream amplification primer 99-430 for SEQ 1542,
cacccatcgcatatttcc

SEQ ID NO: 5477 - DNA, 20 bp, Homo Sapiens
  primer_bind 1..20: upstream amplification primer 99-435 for SEQ 1543,
gtataatttcagtgtgtagg

SEQ ID NO: 5478 - DNA, 18 bp, Homo Sapiens
  primer_bind 1..18: upstream amplification primer 99-449 for SEQ 1544,
ccaggctattcaccattc

SEQ ID NO: 5479 - DNA, 18 bp, Homo Sapiens
  primer_bind 1..18: upstream amplification primer 99-4536 for SEQ 1545,
cggagttttgctcgtggc

SEQ ID NO: 5480 - DNA, 19 bp, Homo Sapiens
  primer_bind 1..19: upstream amplification primer 99-4541 for SEQ 1546,
tatctctcttctacttctc

SEQ ID NO: 5481 - DNA, 20 bp, Homo Sapiens
  primer_bind 1..20: upstream amplification primer 99-4544 for SEQ 1547,
tatacttccctgccacaccc

SEQ ID NO: 5482 - DNA, 18 bp, Homo Sapiens
  primer_bind 1..18: upstream amplification primer 99-4547 for SEQ 1548,
tcatctccctacatttcc

SEQ ID NO: 5483 - DNA, 18 bp, Homo Sapiens
  primer_bind 1..18: upstream amplification primer 99-4595 for SEQ 1549,
ctatggggtctgtaaatg

SEQ ID NO: 5484 - DNA, 18 bp, Homo Sapiens
  primer_bind 1..18: upstream amplification primer 99-4604 for SEQ 1550,
ttctgtgcattttgaccc

SEQ ID NO: 5485 - DNA, 19 bp, Homo Sapiens
  primer_bind 1..19: upstream amplification primer 99-4618 for SEQ 1551,
gactagatcaagagaatcc

SEQ ID NO: 5486 - DNA, 18 bp, Homo Sapiens
  primer_bind 1..18: upstream amplification primer 99-4625 for SEQ 1552,
ggacatttgaccacagag

SEQ ID NO: 5487 - DNA, 18 bp, Homo Sapiens
  primer_bind 1..18: upstream amplification primer 99-4630 for SEQ 1553,
acagttgcttgactttgc

SEQ ID NO: 5488 - DNA, 19 bp, Homo Sapiens
  primer_bind 1..19: upstream amplification primer 99-4644 for SEQ 1554,
gactttagcagcataactc

SEQ ID NO: 5489 - DNA, 18 bp, Homo Sapiens
  primer_bind 1..18: upstream amplification primer 99-465 for SEQ 1555,
ctggctcttcctttcttc

SEQ ID NO: 5490 - DNA, 18 bp, Homo Sapiens
  primer_bind 1..18: upstream amplification primer 99-4655 for SEQ 1556,
cagcaagcatcaaaccag

SEQ ID NO: 5491 - DNA, 19 bp, Homo Sapiens
  primer_bind 1..19: upstream amplification primer 99-466 for SEQ 1557,
aagttgaggggagaaggag

SEQ ID NO: 5492 - DNA, 20 bp, Homo Sapiens
  primer_bind 1..20: upstream amplification primer 99-4666 for SEQ 1558,
gagaaaaggaaagagaagag

SEQ ID NO: 5493 - DNA, 19 bp, Homo Sapiens
  primer_bind 1..19: upstream amplification primer 99-4674 for SEQ 1559,
ctgatctacttttaagcac

SEQ ID NO: 5494 - DNA, 18 bp, Homo Sapiens
  primer_bind 1..18: upstream amplification primer 99-4676 for SEQ 1560,
aaggtatctcaaggtggg

SEQ ID NO: 5495 - DNA, 18 bp, Homo Sapiens
  primer_bind 1..18: upstream amplification primer 99-4677 for SEQ 1561,
acattagccactggtaag

SEQ ID NO: 5496 - DNA, 18 bp, Homo Sapiens
  primer_bind 1..18: upstream amplification primer 99-4679 for SEQ 1562,
tcccgttgctctgaaaag

SEQ ID NO: 5497 - DNA, 21 bp, Homo Sapiens
  primer_bind 1..21: upstream amplification primer 99-4680 for SEQ 1563,
cagtttgagtgctacaaatgg

SEQ ID NO: 5498 - DNA, 18 bp, Homo Sapiens
  primer_bind 1..18: upstream amplification primer 99-4681 for SEQ 1564,
gggaaggtcatcgaggag

SEQ ID NO: 5499 - DNA, 20 bp, Homo Sapiens
  primer_bind 1..20: upstream amplification primer 99-4682 for SEQ 1565,
ccaaaaaccaaaaccaaaac

SEQ ID NO: 5500 - DNA, 19 bp, Homo Sapiens
  primer_bind 1..19: upstream amplification primer 99-4685 for SEQ 1566,
cccaaatatcttctgttcc

SEQ ID NO: 5501 - DNA, 18 bp, Homo Sapiens
  primer_bind 1..18: upstream amplification primer 99-4705 for SEQ 1567,
ccaattcgaggacaatac

SEQ ID NO: 5502 - DNA, 20 bp, Homo Sapiens
  primer_bind 1..20: upstream amplification primer 99-4714 for SEQ 1568,
tctccacatcgctcccattc

SEQ ID NO: 5503 - DNA, 18 bp, Homo Sapiens
  primer_bind 1..18: upstream amplification primer 99-472 for SEQ 1569,
ccttacggaagaagattg

SEQ ID NO: 5504 - DNA, 18 bp, Homo Sapiens
  primer_bind 1..18: upstream amplification primer 99-4725 for SEQ 1570,
tgaagaaactctccaggc

SEQ ID NO: 5505 - DNA, 19 bp, Homo Sapiens
  primer_bind 1..19: upstream amplification primer 99-4756 for SEQ 1571,
cttaatccaaacagaatcc

SEQ ID NO: 5506 - DNA, 18 bp, Homo Sapiens
  primer_bind 1..18: upstream amplification primer 99-4761 for SEQ 1572,
aatgtcatgggtaagggg

SEQ ID NO: 5507 - DNA, 18 bp, Homo Sapiens
  primer_bind 1..18: upstream amplification primer 99-477 for SEQ 1573,
accccctaaagaatccac

SEQ ID NO: 5508 - DNA, 21 bp, Homo Sapiens
  primer_bind 1..21: upstream amplification primer 99-4777 for SEQ 1574,
tcctcagagctatgtccaatg

SEQ ID NO: 5509 - DNA, 18 bp, Homo Sapiens
  primer_bind 1..18: upstream amplification primer 99-4790 for SEQ 1575,
agagtttggagtatggtg

SEQ ID NO: 5510 - DNA, 19 bp, Homo Sapiens
  primer_bind 1..19: upstream amplification primer 99-4796 for SEQ 1576,
tttatcacatagtaagccc

SEQ ID NO: 5511 - DNA, 18 bp, Homo Sapiens
  primer_bind 1..18: upstream amplification primer 99-482 for SEQ 1577,
tcttcacctcacaatctc

SEQ ID NO: 5512 - DNA, 18 bp, Homo Sapiens
  primer_bind 1..18: upstream amplification primer 99-4822 for SEQ 1578,
atatatcccagaccacag

SEQ ID NO: 5513 - DNA, 21 bp, Homo Sapiens
  primer_bind 1..21: upstream amplification primer 99-4823 for SEQ 1579,
gatggagtaattggaaatttg

SEQ ID NO: 5514 - DNA, 19 bp, Homo Sapiens
  primer_bind 1..19: upstream amplification primer 99-483 for SEQ 1580,
attctacaccagcatatac

SEQ ID NO: 5515 - DNA, 19 bp, Homo Sapiens
  primer_bind 1..19: upstream amplification primer 99-4836 for SEQ 1581,
acaattccacttctacaac

SEQ ID NO: 5516 - DNA, 19 bp, Homo Sapiens
  primer_bind 1..19: upstream amplification primer 99-4838 for SEQ 1582,
tgccactacctcaattcac

SEQ ID NO: 5517 - DNA, 20 bp, Homo Sapiens
  primer_bind 1..20: upstream amplification primer 99-4840 for SEQ 1583,
agaagaggaaggggaagagg

SEQ ID NO: 5518 - DNA, 19 bp, Homo Sapiens
  primer_bind 1..19: upstream amplification primer 99-4844 for SEQ 1584,
cctctgaaactaaacatcc

SEQ ID NO: 5519 - DNA, 20 bp, Homo Sapiens
  primer_bind 1..20: upstream amplification primer 99-486 for SEQ 1585,
ctgttagagaggaagaaagc

SEQ ID NO: 5520 - DNA, 18 bp, Homo Sapiens
  primer_bind 1..18: upstream amplification primer 99-4863 for SEQ 1586,
gggagggtatatgtagag

SEQ ID NO: 5521 - DNA, 20 bp, Homo Sapiens
  primer_bind 1..20: upstream amplification primer 99-4882 for SEQ 1587,
acatataccagcagcataag

SEQ ID NO: 5522 - DNA, 18 bp, Homo Sapiens
  primer_bind 1..18: upstream amplification primer 99-4890 for SEQ 1588,
ggcttagagaattaaggg

SEQ ID NO: 5523 - DNA, 18 bp, Homo Sapiens
  primer_bind 1..18: upstream amplification primer 99-4891 for SEQ 1589,
cagagcataatgttcacc

SEQ ID NO: 5524 - DNA, 18 bp, Homo Sapiens
  primer_bind 1..18: upstream amplification primer 99-4895 for SEQ 1590,
tttcacattcccctcatc

SEQ ID NO: 5525 - DNA, 18 bp, Homo Sapiens
  primer_bind 1..18: upstream amplification primer 99-490 for SEQ 1591,
catggactcaacacgttc

SEQ ID NO: 5526 - DNA, 19 bp, Homo Sapiens
  primer_bind 1..19: upstream amplification primer 99-4924 for SEQ 1592,
ggaagagcagtaaaagaag

SEQ ID NO: 5527 - DNA, 19 bp, Homo Sapiens
  primer_bind 1..19: upstream amplification primer 99-4928 for SEQ 1593,
tcgtggcaccagtttcttc

SEQ ID NO: 5528 - DNA, 20 bp, Homo Sapiens
  primer_bind 1..20: upstream amplification primer 99-4950 for SEQ 1594,
ccttgtgatttctcaactcc

SEQ ID NO: 5529 - DNA, 19 bp, Homo Sapiens
  primer_bind 1..19: upstream amplification primer 99-4951 for SEQ 1595,
gaatgttgttgaatagccc

SEQ ID NO: 5530 - DNA, 19 bp, Homo Sapiens
  primer_bind 1..19: upstream amplification primer 99-4956 for SEQ 1596,
aatatcagacattagcagg

SEQ ID NO: 5531 - DNA, 19 bp, Homo Sapiens
  primer_bind 1..19: upstream amplification primer 99-4966 for SEQ 1597,
aaacattacctcttcactc

SEQ ID NO: 5532 - DNA, 18 bp, Homo Sapiens
  primer_bind 1..18: upstream amplification primer 99-4968 for SEQ 1598,
atgggcaatggtggaatc

SEQ ID NO: 5533 - DNA, 19 bp, Homo Sapiens
  primer_bind 1..19: upstream amplification primer 99-5016 for SEQ 1599,
gttctcattgaatactgac

SEQ ID NO: 5534 - DNA, 20 bp, Homo Sapiens
  primer_bind 1..20: upstream amplification primer 99-5029 for SEQ 1600,
agaactgcctgctggacttg

SEQ ID NO: 5535 - DNA, 20 bp, Homo Sapiens
  primer_bind 1..20: upstream amplification primer 99-5032 for SEQ 1601,
tgggcaagcaggtggtaaag

SEQ ID NO: 5536 - DNA, 19 bp, Homo Sapiens
  primer_bind 1..19: upstream amplification primer 99-5036 for SEQ 1602,
gaaaggggtaagtatattg

SEQ ID NO: 5537 - DNA, 18 bp, Homo Sapiens
  primer_bind 1..18: upstream amplification primer 99-5038 for SEQ 1603,
tcaaaaaccacactcacc

SEQ ID NO: 5538 - DNA, 19 bp, Homo Sapiens
  primer_bind 1..19: upstream amplification primer 99-5043 for SEQ 1604,
tatcttgtccccactcacc

SEQ ID NO: 5539 - DNA, 18 bp, Homo Sapiens
  primer_bind 1..18: upstream amplification primer 99-5099 for SEQ 1605,
gtgcatttaaggtgtcag

SEQ ID NO: 5540 - DNA, 19 bp, Homo Sapiens
  primer_bind 1..19: upstream amplification primer 99-5101 for SEQ 1606,
agcagagaaccaggaagac

SEQ ID NO: 5541 - DNA, 18 bp, Homo Sapiens
  primer_bind 1..18: upstream amplification primer 99-5104 for SEQ 1607,
gctggatttctgacctac

SEQ ID NO: 5542 - DNA, 19 bp, Homo Sapiens
  primer_bind 1..19: upstream amplification primer 99-5107 for SEQ 1608,
tcagaggtcatccccttac

SEQ ID NO: 5543 - DNA, 20 bp, Homo Sapiens
  primer_bind 1..20: upstream amplification primer 99-5108 for SEQ 1609,
cagatggagagaatgagaac

SEQ ID NO: 5544 - DNA, 18 bp, Homo Sapiens
  primer_bind 1..18: upstream amplification primer 99-511 for SEQ 1610,
tacttctctctcgaaccc

SEQ ID NO: 5545 - DNA, 19 bp, Homo Sapiens
  primer_bind 1..19: upstream amplification primer 99-5130 for SEQ 1611,
agagaggaatttacctttg

SEQ ID NO: 5546 - DNA, 21 bp, Homo Sapiens
  primer_bind 1..21: upstream amplification primer 99-5142 for SEQ 1612,
ggactgggaagaggattaaag

SEQ ID NO: 5547 - DNA, 21 bp, Homo Sapiens
  primer_bind 1..21: upstream amplification primer 99-5148 for SEQ 1613,
catatctgtcacacctgagcc

SEQ ID NO: 5548 - DNA, 18 bp, Homo Sapiens
  primer_bind 1..18: upstream amplification primer 99-5149 for SEQ 1614,
accacactaacatcttcc

SEQ ID NO: 5549 - DNA, 19 bp, Homo Sapiens
  primer_bind 1..19: upstream amplification primer 99-5157 for SEQ 1615,
tccactcttctccattatc

SEQ ID NO: 5550 - DNA, 19 bp, Homo Sapiens
  primer_bind 1..19: upstream amplification primer 99-5162 for SEQ 1616,
gaaggctctcagaatatag

SEQ ID NO: 5551 - DNA, 18 bp, Homo Sapiens
  primer_bind 1..18: upstream amplification primer 99-5168 for SEQ 1617,
cagtcttggaacaaaggg

SEQ ID NO: 5552 - DNA, 18 bp, Homo Sapiens
  primer_bind 1..18: upstream amplification primer 99-5184 for SEQ 1618,
acccaatggatttcaggc

SEQ ID NO: 5553 - DNA, 18 bp, Homo Sapiens
  primer_bind 1..18: upstream amplification primer 99-5186 for SEQ 1619,
taaaatctcccccatccc

SEQ ID NO: 5554 - DNA, 19 bp, Homo Sapiens
  primer_bind 1..19: upstream amplification primer 99-5189 for SEQ 1620,
catcactacaaaatccatc

SEQ ID NO: 5555 - DNA, 18 bp, Homo Sapiens
  primer_bind 1..18: upstream amplification primer 99-5193 for SEQ 1621,
agcacaagacataatccc

SEQ ID NO: 5556 - DNA, 18 bp, Homo Sapiens
  primer_bind 1..18: upstream amplification primer 99-5194 for SEQ 1622,
ctacttttcaactcgctg

SEQ ID NO: 5557 - DNA, 20 bp, Homo Sapiens
  primer_bind 1..20: upstream amplification primer 99-5199 for SEQ 1623,
ccttaatactttatgtacgc

SEQ ID NO: 5558 - DNA, 19 bp, Homo Sapiens
  primer_bind 1..19: upstream amplification primer 99-5202 for SEQ 1624,
tttggttggggtaaagttg

SEQ ID NO: 5559 - DNA, 18 bp, Homo Sapiens
  primer_bind 1..18: upstream amplification primer 99-5224 for SEQ 1625,
cttggaacattcttcagg

SEQ ID NO: 5560 - DNA, 19 bp, Homo Sapiens
  primer_bind 1..19: upstream amplification primer 99-5225 for SEQ 1626,
caatacatctattctccag

SEQ ID NO: 5561 - DNA, 20 bp, Homo Sapiens
  primer_bind 1..20: upstream amplification primer 99-5226 for SEQ 1627,
catcctattctttgtccttc

SEQ ID NO: 5562 - DNA, 18 bp, Homo Sapiens
  primer_bind 1..18: upstream amplification primer 99-5247 for SEQ 1628,
tcattccaatgggcaaag

SEQ ID NO: 5563 - DNA, 19 bp, Homo Sapiens
  primer_bind 1..19: upstream amplification primer 99-5252 for SEQ 1629,
gaattaccagtatgaccag

SEQ ID NO: 5564 - DNA, 18 bp, Homo Sapiens
  primer_bind 1..18: upstream amplification primer 99-5265 for SEQ 1630,
tagacttaccccttcctc

SEQ ID NO: 5565 - DNA, 18 bp, Homo Sapiens
  primer_bind 1..18: upstream amplification primer 99-5290 for SEQ 1631,
tattaaggttgggagcag

SEQ ID NO: 5566 - DNA, 19 bp, Homo Sapiens
  primer_bind 1..19: upstream amplification primer 99-5291 for SEQ 1632,
agtgtattgaacttgatgg

SEQ ID NO: 5567 - DNA, 18 bp, Homo Sapiens
  primer_bind 1..18: upstream amplification primer 99-5294 for SEQ 1633,
tcgtgctcttctatgacc

SEQ ID NO: 5568 - DNA, 18 bp, Homo Sapiens
  primer_bind 1..18: upstream amplification primer 99-5306 for SEQ 1634,
agtggtttccaatcagtc

SEQ ID NO: 5569 - DNA, 19 bp, Homo Sapiens
  primer_bind 1..19: upstream amplification primer 99-5308 for SEQ 1635,
gataagcaatgtcaatccc

SEQ ID NO: 5570 - DNA, 20 bp, Homo Sapiens
  primer_bind 1..20: upstream amplification primer 99-5312 for SEQ 1636,
tctgtagcctgtagcctctc

SEQ ID NO: 5571 - DNA, 21 bp, Homo Sapiens
  primer_bind 1..21: upstream amplification primer 99-5326 for SEQ 1637,
catttgctacttatgattgtc

SEQ ID NO: 5572 - DNA, 21 bp, Homo Sapiens
  primer_bind 1..21: upstream amplification primer 99-5338 for SEQ 1638,
aagaacattagatgggaaaac

SEQ ID NO: 5573 - DNA, 18 bp, Homo Sapiens
  primer_bind 1..18: upstream amplification primer 99-5355 for SEQ 1639,
aaacaatccgaggttcag

SEQ ID NO: 5574 - DNA, 18 bp, Homo Sapiens
  primer_bind 1..18: upstream amplification primer 99-5356 for SEQ 1640,
tacaggacgcccatatag

SEQ ID NO: 5575 - DNA, 19 bp, Homo Sapiens
  primer_bind 1..19: upstream amplification primer 99-5360 for SEQ 1641,
acaaagccagagcagacag

SEQ ID NO: 5576 - DNA, 18 bp, Homo Sapiens
  primer_bind 1..18: upstream amplification primer 99-5362 for SEQ 1642,
tgtagcactgaggacaac

SEQ ID NO: 5577 - DNA, 18 bp, Homo Sapiens
  primer_bind 1..18: upstream amplification primer 99-5364 for SEQ 1643,
atattgctgtcacctgag

SEQ ID NO: 5578 - DNA, 18 bp, Homo Sapiens
  primer_bind 1..18: upstream amplification primer 99-5379 for SEQ 1644,
tcaaccaaagaactgctc

SEQ ID NO: 5579 - DNA, 20 bp, Homo Sapiens
  primer_bind 1..20: upstream amplification primer 99-5386 for SEQ 1645,
ggattgatttttgatgatgg

SEQ ID NO: 5580 - DNA, 20 bp, Homo Sapiens
  primer_bind 1..20: upstream amplification primer 99-5389 for SEQ 1646,
gtatttggtcacctgttatg

SEQ ID NO: 5581 - DNA, 20 bp, Homo Sapiens
  primer_bind 1..20: upstream amplification primer 99-5390 for SEQ 1647,
cacctgatgaaaatggtctc

SEQ ID NO: 5582 - DNA, 19 bp, Homo Sapiens
  primer_bind 1..19: upstream amplification primer 99-5401 for SEQ 1648,
cgtttctctctagtcgttg

SEQ ID NO: 5583 - DNA, 20 bp, Homo Sapiens
  primer_bind 1..20: upstream amplification primer 99-5405 for SEQ 1649,
ggtccttcttttggatttag

SEQ ID NO: 5584 - DNA, 18 bp, Homo Sapiens
  primer_bind 1..18: upstream amplification primer 99-5406 for SEQ 1650,
ataatgagggaaagggag

SEQ ID NO: 5585 - DNA, 18 bp, Homo Sapiens
  primer_bind 1..18: upstream amplification primer 99-5407 for SEQ 1651,
tgaaggaccagctcttac

SEQ ID NO: 5586 - DNA, 20 bp, Homo Sapiens
  primer_bind 1..20: upstream amplification primer 99-5411 for SEQ 1652,
ctggcattttcttctaattc

SEQ ID NO: 5587 - DNA, 18 bp, Homo Sapiens
  primer_bind 1..18: upstream amplification primer 99-5416 for SEQ 1653,
gtgagacagaataatccc

SEQ ID NO: 5588 - DNA, 18 bp, Homo Sapiens
  primer_bind 1..18: upstream amplification primer 99-5420 for SEQ 1654,
cataagcgttaaagcagc

SEQ ID NO: 5589 - DNA, 20 bp, Homo Sapiens
  primer_bind 1..20: upstream amplification primer 99-5427 for SEQ 1655,
gtgtctcaccttttattttc

SEQ ID NO: 5590 - DNA, 19 bp, Homo Sapiens
  primer_bind 1..19: upstream amplification primer 99-5432 for SEQ 1656,
tattagtgtgttcaagcag

SEQ ID NO: 5591 - DNA, 19 bp, Homo Sapiens
  primer_bind 1..19: upstream amplification primer 99-5433 for SEQ 1657,
ggacatgaaacttcattag

SEQ ID NO: 5592 - DNA, 20 bp, Homo Sapiens
  primer_bind 1..20: upstream amplification primer 99-5437 for SEQ 1658,
ggttattgctaagtccttgc

SEQ ID NO: 5593 - DNA, 21 bp, Homo Sapiens
  primer_bind 1..21: upstream amplification primer 99-5438 for SEQ 1659,
gtcaattcaggaaaaagccag

SEQ ID NO: 5594 - DNA, 19 bp, Homo Sapiens
  primer_bind 1..19: upstream amplification primer 99-5441 for SEQ 1660,
aattatttgccgcacaaac

SEQ ID NO: 5595 - DNA, 19 bp, Homo Sapiens
  primer_bind 1..19: upstream amplification primer 99-5446 for SEQ 1661,
ttcatgctgtgaccttccc

SEQ ID NO: 5596 - DNA, 20 bp, Homo Sapiens
  primer_bind 1..20: upstream amplification primer 99-5447 for SEQ 1662,
cctgttttcacaatttcttc

SEQ ID NO: 5597 - DNA, 18 bp, Homo Sapiens
  primer_bind 1..18: upstream amplification primer 99-5458 for SEQ 1663,
tcatctgctctatgtgcc

SEQ ID NO: 5598 - DNA, 20 bp, Homo Sapiens
  primer_bind 1..20: upstream amplification primer 99-5468 for SEQ 1664,
ggaagcaggaagaaaatgac

SEQ ID NO: 5599 - DNA, 19 bp, Homo Sapiens
  primer_bind 1..19: upstream amplification primer 99-5472 for SEQ 1665,
ctatcaccatttccaaccc

SEQ ID NO: 5600 - DNA, 18 bp, Homo Sapiens
  primer_bind 1..18: upstream amplification primer 99-5475 for SEQ 1666,
ctgaaagcccttcaagag

SEQ ID NO: 5601 - DNA, 21 bp, Homo Sapiens
  primer_bind 1..21: upstream amplification primer 99-5477 for SEQ 1667,
ctcttatcatttagccatttc

SEQ ID NO: 5602 - DNA, 18 bp, Homo Sapiens
  primer_bind 1..18: upstream amplification primer 99-5485 for SEQ 1668,
ctaataaataggcagcgg

SEQ ID NO: 5603 - DNA, 19 bp, Homo Sapiens
  primer_bind 1..19: upstream amplification primer 99-5490 for SEQ 1669,
gacaaaacccacacaaaag

SEQ ID NO: 5604 - DNA, 21 bp, Homo Sapiens
  primer_bind 1..21: upstream amplification primer 99-5494 for SEQ 1670,
ccattctactgatagataaac

SEQ ID NO: 5605 - DNA, 19 bp, Homo Sapiens
  primer_bind 1..19: upstream amplification primer 99-5502 for SEQ 1671,
atcatagccagttggggac

SEQ ID NO: 5606 - DNA, 18 bp, Homo Sapiens
  primer_bind 1..18: upstream amplification primer 99-5505 for SEQ 1672,
tccctttgcttaccacac

SEQ ID NO: 5607 - DNA, 19 bp, Homo Sapiens
  primer_bind 1..19: upstream amplification primer 99-5516 for SEQ 1673,
ataggtttgtttagtctgg

SEQ ID NO: 5608 - DNA, 21 bp, Homo Sapiens
  primer_bind 1..21: upstream amplification primer 99-5526 for SEQ 1674,
ctacacacatcacttaaattc

SEQ ID NO: 5609 - DNA, 21 bp, Homo Sapiens
  primer_bind 1..21: upstream amplification primer 99-5566 for SEQ 1675,
tttgtgtgcttcatttagctc

SEQ ID NO: 5610 - DNA, 19 bp, Homo Sapiens
  primer_bind 1..19: upstream amplification primer 99-5582 for SEQ 1676,
tcatcagttcaaatagtcc

SEQ ID NO: 5611 - DNA, 19 bp, Homo Sapiens
  primer_bind 1..19: upstream amplification primer 99-5590 for SEQ 1677,
atgcccattgaatttctac

SEQ ID NO: 5612 - DNA, 18 bp, Homo Sapiens
  primer_bind 1..18: upstream amplification primer 99-5595 for SEQ 1678,
cagatcatggttctgaag

SEQ ID NO: 5613 - DNA, 18 bp, Homo Sapiens
  primer_bind 1..18: upstream amplification primer 99-5596 for SEQ 1679,
taagtcttgtgccacatc

SEQ ID NO: 5614 - DNA, 20 bp, Homo Sapiens
  primer_bind 1..20: upstream amplification primer 99-5604 for SEQ 1680,
ctttaccaaaatcactctac

SEQ ID NO: 5615 - DNA, 19 bp, Homo Sapiens
  primer_bind 1..19: upstream amplification primer 99-5608 for SEQ 1681,
caaatcaagtgtagcaagg

SEQ ID NO: 5616 - DNA, 20 bp, Homo Sapiens
  primer_bind 1..20: upstream amplification primer 99-5632 for SEQ 1682,
gttgttgttgaacatgatgg

SEQ ID NO: 5617 - DNA, 19 bp, Homo Sapiens
  primer_bind 1..19: upstream amplification primer 99-5633 for SEQ 1683,
gcttctctagcagaaaagg

SEQ ID NO: 5618 - DNA, 18 bp, Homo Sapiens
  primer_bind 1..18: upstream amplification primer 99-5634 for SEQ 1684,
gctacaatgtgtttcccc

SEQ ID NO: 5619 - DNA, 18 bp, Homo Sapiens
  primer_bind 1..18: upstream amplification primer 99-5636 for SEQ 1685,
agtttgggtcaggctttc

SEQ ID NO: 5620 - DNA, 19 bp, Homo Sapiens
  primer_bind 1..19: upstream amplification primer 99-5660 for SEQ 1686,
tcttaaaggtcactggttc

SEQ ID NO: 5621 - DNA, 19 bp, Homo Sapiens
  primer_bind 1..19: upstream amplification primer 99-5670 for SEQ 1687,
acagatgagtgtcacctgg

SEQ ID NO: 5622 - DNA, 19 bp, Homo Sapiens
  primer_bind 1..19: upstream amplification primer 99-5678 for SEQ 1688,
ggataagattctgggatag

SEQ ID NO: 5623 - DNA, 19 bp, Homo Sapiens
  primer_bind 1..19: upstream amplification primer 99-5680 for SEQ 1689,
gccaatattctctccagac

SEQ ID NO: 5624 - DNA, 20 bp, Homo Sapiens
  primer_bind 1..20: upstream amplification primer 99-5681 for SEQ 1690,
gctctgttattcttgctatg

SEQ ID NO: 5625 - DNA, 20 bp, Homo Sapiens
  primer_bind 1..20: upstream amplification primer 99-5685 for SEQ 1691,
ttggtggtcggtgttacctc

SEQ ID NO: 5626 - DNA, 20 bp, Homo Sapiens
  primer_bind 1..20: upstream amplification primer 99-5686 for SEQ 1692,
ctcacatcaaagccaccctc

SEQ ID NO: 5627 - DNA, 18 bp, Homo Sapiens
  primer_bind 1..18: upstream amplification primer 99-5700 for SEQ 1693,
actgacaaacacatcagc

SEQ ID NO: 5628 - DNA, 18 bp, Homo Sapiens
  primer_bind 1..18: upstream amplification primer 99-5702 for SEQ 1694,
gcactgtaataatggggg

SEQ ID NO: 5629 - DNA, 19 bp, Homo Sapiens
  primer_bind 1..19: upstream amplification primer 99-5703 for SEQ 1695,
agtggatactcttggctgg

SEQ ID NO: 5630 - DNA, 20 bp, Homo Sapiens
  primer_bind 1..20: upstream amplification primer 99-5709 for SEQ 1696,
taggcaatccagacacatcc

SEQ ID NO: 5631 - DNA, 19 bp, Homo Sapiens
  primer_bind 1..19: upstream amplification primer 99-5711 for SEQ 1697,
cccatcttttcagtgtgtg

SEQ ID NO: 5632 - DNA, 18 bp, Homo Sapiens
  primer_bind 1..18: upstream amplification primer 99-5712 for SEQ 1698,
cttggtaaggctctgttg

SEQ ID NO: 5633 - DNA, 20 bp, Homo Sapiens
  primer_bind 1..20: upstream amplification primer 99-5727 for SEQ 1699,
gtatatgtatatgtggcagg

SEQ ID NO: 5634 - DNA, 19 bp, Homo Sapiens
  primer_bind 1..19: upstream amplification primer 99-5729 for SEQ 1700,
gtaagttagaaagggtagg

SEQ ID NO: 5635 - DNA, 19 bp, Homo Sapiens
  primer_bind 1..19: upstream amplification primer 99-5731 for SEQ 1701,
tttctacatctgtgcttac

SEQ ID NO: 5636 - DNA, 18 bp, Homo Sapiens
  primer_bind 1..18: upstream amplification primer 99-5741 for SEQ 1702,
taaatcctggtctgacac

SEQ ID NO: 5637 - DNA, 21 bp, Homo Sapiens
  primer_bind 1..21: upstream amplification primer 99-5742 for SEQ 1703,
catgcttgaggaaactaatgg

SEQ ID NO: 5638 - DNA, 19 bp, Homo Sapiens
  primer_bind 1..19: upstream amplification primer 99-5745 for SEQ 1704,
tacagcagactcaaggtgg

SEQ ID NO: 5639 - DNA, 20 bp, Homo Sapiens
  primer_bind 1..20: upstream amplification primer 99-5756 for SEQ 1705,
gataaagaaggaagagaagg

SEQ ID NO: 5640 - DNA, 18 bp, Homo Sapiens
  primer_bind 1..18: upstream amplification primer 99-576 for SEQ 1706,
gtgctgctgagacaaaag

SEQ ID NO: 5641 - DNA, 21 bp, Homo Sapiens
  primer_bind 1..21: upstream amplification primer 99-5760 for SEQ 1707,
agatgtttggcattttggagg

SEQ ID NO: 5642 - DNA, 21 bp, Homo Sapiens
  primer_bind 1..21: upstream amplification primer 99-5770 for SEQ 1708,
ctataaacataccataggttc

SEQ ID NO: 5643 - DNA, 19 bp, Homo Sapiens
  primer_bind 1..19: upstream amplification primer 99-5781 for SEQ 1709,
atgaaagaaatcctacctg

SEQ ID NO: 5644 - DNA, 21 bp, Homo Sapiens
  primer_bind 1..21: upstream amplification primer 99-5795 for SEQ 1710,
ttacatttacactgttttccc

SEQ ID NO: 5645 - DNA, 19 bp, Homo Sapiens
  primer_bind 1..19: upstream amplification primer 99-5813 for SEQ 1711,
ccattcctctctacataac

SEQ ID NO: 5646 - DNA, 21 bp, Homo Sapiens
  primer_bind 1..21: upstream amplification primer 99-582 for SEQ 1712,
ggattaatgataattggtgag

SEQ ID NO: 5647 - DNA, 19 bp, Homo Sapiens
  primer_bind 1..19: upstream amplification primer 99-5832 for SEQ 1713,
cattaaaatttagaggcgg

SEQ ID NO: 5648 - DNA, 18 bp, Homo Sapiens
  primer_bind 1..18: upstream amplification primer 99-5836 for SEQ 1714,
acactcacactttgtacc

SEQ ID NO: 5649 - DNA, 19 bp, Homo Sapiens
  primer_bind 1..19: upstream amplification primer 99-5837 for SEQ 1715,
ggggttatgcagtataatc

SEQ ID NO: 5650 - DNA, 18 bp, Homo Sapiens
  primer_bind 1..18: upstream amplification primer 99-5860 for SEQ 1716,
aaggaaggttgagaaagg

SEQ ID NO: 5651 - DNA, 18 bp, Homo Sapiens
  primer_bind 1..18: upstream amplification primer 99-5867 for SEQ 1717,
accctatgtctactatcg

SEQ ID NO: 5652 - DNA, 18 bp, Homo Sapiens
  primer_bind 1..18: upstream amplification primer 99-5875 for SEQ 1718,
acaaagcagatgatggag

SEQ ID NO: 5653 - DNA, 19 bp, Homo Sapiens
  primer_bind 1..19: upstream amplification primer 99-5893 for SEQ 1719,
aaaagaataggaggaaagg

SEQ ID NO: 5654 - DNA, 19 bp, Homo Sapiens
  primer_bind 1..19: upstream amplification primer 99-5907 for SEQ 1720,
gaaaaaaattgtgggaggg

SEQ ID NO: 5655 - DNA, 21 bp, Homo Sapiens
  primer_bind 1..21: upstream amplification primer 99-5908 for SEQ 1721,
gggagtggtgagaaatgagtg

SEQ ID NO: 5656 - DNA, 19 bp, Homo Sapiens
  primer_bind 1..19: upstream amplification primer 99-5909 for SEQ 1722,
cttatacagaagagcagag

SEQ ID NO: 5657 - DNA, 21 bp, Homo Sapiens
  primer_bind 1..21: upstream amplification primer 99-5912 for SEQ 1723,
gtcaaatcatgttaccattag

SEQ ID NO: 5658 - DNA, 18 bp, Homo Sapiens
  primer_bind 1..18: upstream amplification primer 99-5915 for SEQ 1724,
aaaaactctggactctgg

SEQ ID NO: 5659 - DNA, 18 bp, Homo Sapiens
  primer_bind 1..18: upstream amplification primer 99-5951 for SEQ 1725,
ctgtcagactgtctatac

SEQ ID NO: 5660 - DNA, 19 bp, Homo Sapiens
  primer_bind 1..19: upstream amplification primer 99-5957 for SEQ 1726,
tatttgtaatgcaggcttc

SEQ ID NO: 5661 - DNA, 21 bp, Homo Sapiens
  primer_bind 1..21: upstream amplification primer 99-596 for SEQ 1727,
ctgttctttctgacgtttttg

SEQ ID NO: 5662 - DNA, 19 bp, Homo Sapiens
  primer_bind 1..19: upstream amplification primer 99-5968 for SEQ 1728,
cagagaagttcattcccag

SEQ ID NO: 5663 - DNA, 18 bp, Homo Sapiens
  primer_bind 1..18: upstream amplification primer 99-5979 for SEQ 1729,
acaaagacctaacactcc

SEQ ID NO: 5664 - DNA, 19 bp, Homo Sapiens
  primer_bind 1..19: upstream amplification primer 99-598 for SEQ 1730,
gcaaaccaaaaacaagaag

SEQ ID NO: 5665 - DNA, 18 bp, Homo Sapiens
  primer_bind 1..18: upstream amplification primer 99-6007 for SEQ 1731,
acaaaagtgaagcagcag

SEQ ID NO: 5666 - DNA, 19 bp, Homo Sapiens
  primer_bind 1..19: upstream amplification primer 99-6012 for SEQ 1732,
gtcttgacttgttttcctg

SEQ ID NO: 5667 - DNA, 19 bp, Homo Sapiens
  primer_bind 1..19: upstream amplification primer 99-602 for SEQ 1733,
ggtaagatggtatgaattg

SEQ ID NO: 5668 - DNA, 19 bp, Homo Sapiens
  primer_bind 1..19: upstream amplification primer 99-6038 for SEQ 1734,
ctttaacatagtgagagcc

SEQ ID NO: 5669 - DNA, 18 bp, Homo Sapiens
  primer_bind 1..18: upstream amplification primer 99-6042 for SEQ 1735,
tggaaaattgagagaggg

SEQ ID NO: 5670 - DNA, 20 bp, Homo Sapiens
  primer_bind 1..20: upstream amplification primer 99-6051 for SEQ 1736,
cctttactttttacctctcc

SEQ ID NO: 5671 - DNA, 18 bp, Homo Sapiens
  primer_bind 1..18: upstream amplification primer 99-6067 for SEQ 1737,
tgaagagtaggtatgggg

SEQ ID NO: 5672 - DNA, 21 bp, Homo Sapiens
  primer_bind 1..21: upstream amplification primer 99-6069 for SEQ 1738,
ccaaaaacaaacaatccaaac

SEQ ID NO: 5673 - DNA, 19 bp, Homo Sapiens
  primer_bind 1..19: upstream amplification primer 99-607 for SEQ 1739,
cataagtgatttccctaag

SEQ ID NO: 5674 - DNA, 21 bp, Homo Sapiens
  primer_bind 1..21: upstream amplification primer 99-6077 for SEQ 1740,
gacaagcccatattgataaag

SEQ ID NO: 5675 - DNA, 19 bp, Homo Sapiens
  primer_bind 1..19: upstream amplification primer 99-6079 for SEQ 1741,
gacacagaccattcaatag

SEQ ID NO: 5676 - DNA, 18 bp, Homo Sapiens
  primer_bind 1..18: upstream amplification primer 99-608 for SEQ 1742,
ggagaaggtaagtttagg

SEQ ID NO: 5677 - DNA, 18 bp, Homo Sapiens
  primer_bind 1..18: upstream amplification primer 99-6080 for SEQ 1743,
aaatgtgtccctgaaacc

SEQ ID NO: 5678 - DNA, 19 bp, Homo Sapiens
  primer_bind 1..19: upstream amplification primer 99-609 for SEQ 1744,
tgagacataacgcaaatac

SEQ ID NO: 5679 - DNA, 18 bp, Homo Sapiens
  primer_bind 1..18: upstream amplification primer 99-6091 for SEQ 1745,
atccccgttacacacaag

SEQ ID NO: 5680 - DNA, 20 bp, Homo Sapiens
  primer_bind 1..20: upstream amplification primer 99-6094 for SEQ 1746,
cacgacgtgaaagaatttgg

SEQ ID NO: 5681 - DNA, 21 bp, Homo Sapiens
  primer_bind 1..21: upstream amplification primer 99-6095 for SEQ 1747,
gttaagtgtgaattgttgttg

SEQ ID NO: 5682 - DNA, 18 bp, Homo Sapiens
  primer_bind 1..18: upstream amplification primer 99-6097 for SEQ 1748,
ctgtccctgaaaagtctg

SEQ ID NO: 5683 - DNA, 18 bp, Homo Sapiens
  primer_bind 1..18: upstream amplification primer 99-610 for SEQ 1749,
taggcaaagctatacctc

SEQ ID NO: 5684 - DNA, 18 bp, Homo Sapiens
  primer_bind 1..18: upstream amplification primer 99-6112 for SEQ 1750,
aactatgattccctcccc

SEQ ID NO: 5685 - DNA, 18 bp, Homo Sapiens
  primer_bind 1..18: upstream amplification primer 99-6117 for SEQ 1751,
cattaggattgcttgagg

SEQ ID NO: 5686 - DNA, 20 bp, Homo Sapiens
  primer_bind 1..20: upstream amplification primer 99-6122 for SEQ 1752,
caaactcagggaattttagg

SEQ ID NO: 5687 - DNA, 18 bp, Homo Sapiens
  primer_bind 1..18: upstream amplification primer 99-6131 for SEQ 1753,
tagcatgggtataggttc

SEQ ID NO: 5688 - DNA, 19 bp, Homo Sapiens
  primer_bind 1..19: upstream amplification primer 99-6135 for SEQ 1754,
tcttcattttcctctcacc

SEQ ID NO: 5689 - DNA, 19 bp, Homo Sapiens
  primer_bind 1..19: upstream amplification primer 99-614 for SEQ 1755,
accctctgtactggatctg

SEQ ID NO: 5690 - DNA, 21 bp, Homo Sapiens
  primer_bind 1..21: upstream amplification primer 99-6141 for SEQ 1756,
cttctagtcttctgtgacttg

SEQ ID NO: 5691 - DNA, 19 bp, Homo Sapiens
  primer_bind 1..19: upstream amplification primer 99-615 for SEQ 1757,
gggtgtgttctgtaaagtc

SEQ ID NO: 5692 - DNA, 18 bp, Homo Sapiens
  primer_bind 1..18: upstream amplification primer 99-616 for SEQ 1758,
tcctcttgacatcattcc

SEQ ID NO: 5693 - DNA, 19 bp, Homo Sapiens
  primer_bind 1..19: upstream amplification primer 99-6176 for SEQ 1759,
tcctaaaattcccaaaacc

SEQ ID NO: 5694 - DNA, 18 bp, Homo Sapiens
  primer_bind 1..18: upstream amplification primer 99-6180 for SEQ 1760,
actaggctaagaagtcag

SEQ ID NO: 5695 - DNA, 19 bp, Homo Sapiens
  primer_bind 1..19: upstream amplification primer 99-6181 for SEQ 1761,
agttttgcatgttttgacc

SEQ ID NO: 5696 - DNA, 18 bp, Homo Sapiens
  primer_bind 1..18: upstream amplification primer 99-6189 for SEQ 1762,
cccatctgacctttttcc

SEQ ID NO: 5697 - DNA, 19 bp, Homo Sapiens
  primer_bind 1..19: upstream amplification primer 99-619 for SEQ 1763,
ttccaaacccctacctctc

SEQ ID NO: 5698 - DNA, 20 bp, Homo Sapiens
  primer_bind 1..20: upstream amplification primer 99-6191 for SEQ 1764,
tcttaggagcatgtgacctg

SEQ ID NO: 5699 - DNA, 19 bp, Homo Sapiens
  primer_bind 1..19: upstream amplification primer 99-6193 for SEQ 1765,
tcttcatcttcatctcatc

SEQ ID NO: 5700 - DNA, 21 bp, Homo Sapiens
  primer_bind 1..21: upstream amplification primer 99-621 for SEQ 1766,
caactttccttttaatttccc

SEQ ID NO: 5701 - DNA, 19 bp, Homo Sapiens
  primer_bind 1..19: upstream amplification primer 99-6217 for SEQ 1767,
ctgcatacaaaagtagttc

SEQ ID NO: 5702 - DNA, 19 bp, Homo Sapiens
  primer_bind 1..19: upstream amplification primer 99-622 for SEQ 1768,
cctactactacttctcttc

SEQ ID NO: 5703 - DNA, 18 bp, Homo Sapiens
  primer_bind 1..18: upstream amplification primer 99-6253 for SEQ 1769,
caccaccctactttatac

SEQ ID NO: 5704 - DNA, 20 bp, Homo Sapiens
  primer_bind 1..20: upstream amplification primer 99-6257 for SEQ 1770,
ctaccttttattgagctacc

SEQ ID NO: 5705 - DNA, 19 bp, Homo Sapiens
  primer_bind 1..19: upstream amplification primer 99-6261 for SEQ 1771,
gatgatgtgtgaatgtagg

SEQ ID NO: 5706 - DNA, 18 bp, Homo Sapiens
  primer_bind 1..18: upstream amplification primer 99-6278 for SEQ 1772,
ttccccactgtccctgtc

SEQ ID NO: 5707 - DNA, 19 bp, Homo Sapiens
  primer_bind 1..19: upstream amplification primer 99-6294 for SEQ 1773,
tagaaaaggcaggcgtctc

SEQ ID NO: 5708 - DNA, 18 bp, Homo Sapiens
  primer_bind 1..18: upstream amplification primer 99-6298 for SEQ 1774,
tccatgctcttaccagtg

SEQ ID NO: 5709 - DNA, 19 bp, Homo Sapiens
  primer_bind 1..19: upstream amplification primer 99-6300 for SEQ 1775,
tctggttcactgttgggtc

SEQ ID NO: 5710 - DNA, 19 bp, Homo Sapiens
  primer_bind 1..19: upstream amplification primer 99-6310 for SEQ 1776,
caagcagacataaaaatcc

SEQ ID NO: 5711 - DNA, 19 bp, Homo Sapiens
  primer_bind 1..19: upstream amplification primer 99-632 for SEQ 1777,
gacattgcttccttttacc

SEQ ID NO: 5712 - DNA, 18 bp, Homo Sapiens
  primer_bind 1..18: upstream amplification primer 99-6327 for SEQ 1778,
agaggttagagtgacctg

SEQ ID NO: 5713 - DNA, 19 bp, Homo Sapiens
  primer_bind 1..19: upstream amplification primer 99-6332 for SEQ 1779,
cgattaaacctatgacctg

SEQ ID NO: 5714 - DNA, 20 bp, Homo Sapiens
  primer_bind 1..20: upstream amplification primer 99-6367 for SEQ 1780,
cttttattccacaagcagag

SEQ ID NO: 5715 - DNA, 18 bp, Homo Sapiens
  primer_bind 1..18: upstream amplification primer 99-6368 for SEQ 1781,
cccatttactcttccttc

SEQ ID NO: 5716 - DNA, 18 bp, Homo Sapiens
  primer_bind 1..18: upstream amplification primer 99-6404 for SEQ 1782,
atgataacagcagactcc

SEQ ID NO: 5717 - DNA, 18 bp, Homo Sapiens
  primer_bind 1..18: upstream amplification primer 99-6409 for SEQ 1783,
ggaagccagaaggaggac

SEQ ID NO: 5718 - DNA, 20 bp, Homo Sapiens
  primer_bind 1..20: upstream amplification primer 99-6411 for SEQ 1784,
tcactcccttcctgaagtcc

SEQ ID NO: 5719 - DNA, 18 bp, Homo Sapiens
  primer_bind 1..18: upstream amplification primer 99-6413 for SEQ 1785,
tcggagggtaatcaatgg

SEQ ID NO: 5720 - DNA, 18 bp, Homo Sapiens
  primer_bind 1..18: upstream amplification primer 99-6415 for SEQ 1786,
ttcccaatgtccgtttag

SEQ ID NO: 5721 - DNA, 18 bp, Homo Sapiens
  primer_bind 1..18: upstream amplification primer 99-6421 for SEQ 1787,
aggtgaggaaagaaagag

SEQ ID NO: 5722 - DNA, 18 bp, Homo Sapiens
  primer_bind 1..18: upstream amplification primer 99-6423 for SEQ 1788,
tgtgatgttccagttgac

SEQ ID NO: 5723 - DNA, 19 bp, Homo Sapiens
  primer_bind 1..19: upstream amplification primer 99-6426 for SEQ 1789,
aaaccatcaccacccaacc

SEQ ID NO: 5724 - DNA, 19 bp, Homo Sapiens
  primer_bind 1..19: upstream amplification primer 99-6427 for SEQ 1790,
cccttctttatggcttttg

SEQ ID NO: 5725 - DNA, 18 bp, Homo Sapiens
  primer_bind 1..18: upstream amplification primer 99-6435 for SEQ 1791,
atggggatgagctatatg

SEQ ID NO: 5726 - DNA, 19 bp, Homo Sapiens
  primer_bind 1..19: upstream amplification primer 99-6437 for SEQ 1792,
acttctcccaaatactttc

SEQ ID NO: 5727 - DNA, 20 bp, Homo Sapiens
  primer_bind 1..20: upstream amplification primer 99-6440 for SEQ 1793,
ctttttacttcatacactcc

SEQ ID NO: 5728 - DNA, 19 bp, Homo Sapiens
  primer_bind 1..19: upstream amplification primer 99-6447 for SEQ 1794,
atttacaactcatccatcc

SEQ ID NO: 5729 - DNA, 19 bp, Homo Sapiens
  primer_bind 1..19: upstream amplification primer 99-6456 for SEQ 1795,
aaccactgcacttctagcg

SEQ ID NO: 5730 - DNA, 18 bp, Homo Sapiens
  primer_bind 1..18: upstream amplification primer 99-6459 for SEQ 1796,
cctctcttacttacactc

SEQ ID NO: 5731 - DNA, 19 bp, Homo Sapiens
  primer_bind 1..19: upstream amplification primer 99-646 for SEQ 1797,
tgcttattcagaaaagagg

SEQ ID NO: 5732 - DNA, 19 bp, Homo Sapiens
  primer_bind 1..19: upstream amplification primer 99-6463 for SEQ 1798,
acccactccagtagtcttc

SEQ ID NO: 5733 - DNA, 20 bp, Homo Sapiens
  primer_bind 1..20: upstream amplification primer 99-6468 for SEQ 1799,
tgcttccccacttcgttctc

SEQ ID NO: 5734 - DNA, 20 bp, Homo Sapiens
  primer_bind 1..20: upstream amplification primer 99-6478 for SEQ 1800,
gagaatgtggaaataggatg

SEQ ID NO: 5735 - DNA, 18 bp, Homo Sapiens
  primer_bind 1..18: upstream amplification primer 99-6480 for SEQ 1801,
cagttctacagtggagac

SEQ ID NO: 5736 - DNA, 18 bp, Homo Sapiens
  primer_bind 1..18: upstream amplification primer 99-6489 for SEQ 1802,
tgtttaacctctttgccc

SEQ ID NO: 5737 - DNA, 19 bp, Homo Sapiens
  primer_bind 1..19: upstream amplification primer 99-649 for SEQ 1803,
gactcactacttaacttcc

SEQ ID NO: 5738 - DNA, 19 bp, Homo Sapiens
  primer_bind 1..19: upstream amplification primer 99-6496 for SEQ 1804,
ccacaccttcctgaattag

SEQ ID NO: 5739 - DNA, 20 bp, Homo Sapiens
  primer_bind 1..20: upstream amplification primer 99-6511 for SEQ 1805,
ctcatcacctcttatccttc

SEQ ID NO: 5740 - DNA, 19 bp, Homo Sapiens
  primer_bind 1..19: upstream amplification primer 99-6525 for SEQ 1806,
tgtgtgtcccctttctgag

SEQ ID NO: 5741 - DNA, 19 bp, Homo Sapiens
  primer_bind 1..19: upstream amplification primer 99-6527 for SEQ 1807,
gagatgttcaagagaccag

SEQ ID NO: 5742 - DNA, 18 bp, Homo Sapiens
  primer_bind 1..18: upstream amplification primer 99-6529 for SEQ 1808,
gcttgattgctttgtggg

SEQ ID NO: 5743 - DNA, 19 bp, Homo Sapiens
  primer_bind 1..19: upstream amplification primer 99-6539 for SEQ 1809,
catcttcctctataagtcc

SEQ ID NO: 5744 - DNA, 18 bp, Homo Sapiens
  primer_bind 1..18: upstream amplification primer 99-6557 for SEQ 1810,
ggtaagtaagagatgagg

SEQ ID NO: 5745 - DNA, 21 bp, Homo Sapiens
  primer_bind 1..21: upstream amplification primer 99-658 for SEQ 1811,
gacagtagataaggatataag

SEQ ID NO: 5746 - DNA, 19 bp, Homo Sapiens
  primer_bind 1..19: upstream amplification primer 99-6581 for SEQ 1812,
agtgtgtagttgagaattg

SEQ ID NO: 5747 - DNA, 18 bp, Homo Sapiens
  primer_bind 1..18: upstream amplification primer 99-6586 for SEQ 1813,
agatggatgtggtagatg

SEQ ID NO: 5748 - DNA, 18 bp, Homo Sapiens
  primer_bind 1..18: upstream amplification primer 99-6588 for SEQ 1814,
tcaaacagacaagccaac

SEQ ID NO: 5749 - DNA, 18 bp, Homo Sapiens
  primer_bind 1..18: upstream amplification primer 99-6595 for SEQ 1815,
acagcatttgtcggcaag

SEQ ID NO: 5750 - DNA, 19 bp, Homo Sapiens
  primer_bind 1..19: upstream amplification primer 99-6609 for SEQ 1816,
ctcaactcctctttacaac

SEQ ID NO: 5751 - DNA, 18 bp, Homo Sapiens
  primer_bind 1..18: upstream amplification primer 99-6612 for SEQ 1817,
tcccaagattgaaaggtg

SEQ ID NO: 5752 - DNA, 20 bp, Homo Sapiens
  primer_bind 1..20: upstream amplification primer 99-6613 for SEQ 1818,
agatgaggagtggagggaag

SEQ ID NO: 5753 - DNA, 21 bp, Homo Sapiens
  primer_bind 1..21: upstream amplification primer 99-6620 for SEQ 1819,
tagaacaatcttaatctctcc

SEQ ID NO: 5754 - DNA, 19 bp, Homo Sapiens
  primer_bind 1..19: upstream amplification primer 99-6628 for SEQ 1820,
ggttatctgcaaagaagtc

SEQ ID NO: 5755 - DNA, 18 bp, Homo Sapiens
  primer_bind 1..18: upstream amplification primer 99-6639 for SEQ 1821,
aagggttgtcttactcag

SEQ ID NO: 5756 - DNA, 21 bp, Homo Sapiens
  primer_bind 1..21: upstream amplification primer 99-6640 for SEQ 1822,
gcaacttccagtaatttattg

SEQ ID NO: 5757 - DNA, 18 bp, Homo Sapiens
  primer_bind 1..18: upstream amplification primer 99-6646 for SEQ 1823,
catccctccactatctac

SEQ ID NO: 5758 - DNA, 19 bp, Homo Sapiens
  primer_bind 1..19: upstream amplification primer 99-6667 for SEQ 1824,
accctctccaaccatttcc

SEQ ID NO: 5759 - DNA, 18 bp, Homo Sapiens
  primer_bind 1..18: upstream amplification primer 99-6672 for SEQ 1825,
atccctccctataacttg

SEQ ID NO: 5760 - DNA, 19 bp, Homo Sapiens
  primer_bind 1..19: upstream amplification primer 99-6675 for SEQ 1826,
gaggaaagaattgaaagag

SEQ ID NO: 5761 - DNA, 18 bp, Homo Sapiens
  primer_bind 1..18: upstream amplification primer 99-6688 for SEQ 1827,
ctgaagggttgaatgctg

SEQ ID NO: 5762 - DNA, 19 bp, Homo Sapiens
  primer_bind 1..19: upstream amplification primer 99-669 for SEQ 1828,
aaatcacattgctccaaac

SEQ ID NO: 5763 - DNA, 19 bp, Homo Sapiens
  primer_bind 1..19: upstream amplification primer 99-6697 for SEQ 1829,
tcctgtatatgccaaaaag

SEQ ID NO: 5764 - DNA, 19 bp, Homo Sapiens
  primer_bind 1..19: upstream amplification primer 99-670 for SEQ 1830,
cttttctttcccttcattc

SEQ ID NO: 5765 - DNA, 21 bp, Homo Sapiens
  primer_bind 1..21: upstream amplification primer 99-6705 for SEQ 1831,
gaaagaagtcagtcataaagg

SEQ ID NO: 5766 - DNA, 18 bp, Homo Sapiens
  primer_bind 1..18: upstream amplification primer 99-6706 for SEQ 1832,
gaatcatgtctgtagtgg

SEQ ID NO: 5767 - DNA, 18 bp, Homo Sapiens
  primer_bind 1..18: upstream amplification primer 99-6715 for SEQ 1833,
cataccctgacttgaacc

SEQ ID NO: 5768 - DNA, 18 bp, Homo Sapiens
  primer_bind 1..18: upstream amplification primer 99-6726 for SEQ 1834,
gaagactctcacattgcc

SEQ ID NO: 5769 - DNA, 18 bp, Homo Sapiens
  primer_bind 1..18: upstream amplification primer 99-6730 for SEQ 1835,
gagtgggagaagagattg

SEQ ID NO: 5770 - DNA, 18 bp, Homo Sapiens
  primer_bind 1..18: upstream amplification primer 99-6753 for SEQ 1836,
acccccataaaactgaac

SEQ ID NO: 5771 - DNA, 21 bp, Homo Sapiens
  primer_bind 1..21: upstream amplification primer 99-6757 for SEQ 1837,
gatgtaaagagatggataaag

SEQ ID NO: 5772 - DNA, 19 bp, Homo Sapiens
  primer_bind 1..19: upstream amplification primer 99-676 for SEQ 1838,
ttaagacctactttgctac

SEQ ID NO: 5773 - DNA, 21 bp, Homo Sapiens
  primer_bind 1..21: upstream amplification primer 99-6781 for SEQ 1839,
ctacatcatttattgtcagtg

SEQ ID NO: 5774 - DNA, 18 bp, Homo Sapiens
  primer_bind 1..18: upstream amplification primer 99-6790 for SEQ 1840,
ggtgtcttgtgtgtatgg

SEQ ID NO: 5775 - DNA, 18 bp, Homo Sapiens
  primer_bind 1..18: upstream amplification primer 99-680 for SEQ 1841,
aatatacccaggggaaag

SEQ ID NO: 5776 - DNA, 19 bp, Homo Sapiens
  primer_bind 1..19: upstream amplification primer 99-6804 for SEQ 1842,
ttgggagtagatgataatg

SEQ ID NO: 5777 - DNA, 20 bp, Homo Sapiens
  primer_bind 1..20: upstream amplification primer 99-6815 for SEQ 1843,
gtaggatatgtaagtaaagg

SEQ ID NO: 5778 - DNA, 19 bp, Homo Sapiens
  primer_bind 1..19: upstream amplification primer 99-6820 for SEQ 1844,
gtggtttttctgtccattc

SEQ ID NO: 5779 - DNA, 21 bp, Homo Sapiens
  primer_bind 1..21: upstream amplification primer 99-6832 for SEQ 1845,
ctctaagcattcattcacttc

SEQ ID NO: 5780 - DNA, 20 bp, Homo Sapiens
  primer_bind 1..20: upstream amplification primer 99-6856 for SEQ 1846,
ggaagaataaaatgggatgg

SEQ ID NO: 5781 - DNA, 20 bp, Homo Sapiens
  primer_bind 1..20: upstream amplification primer 99-6865 for SEQ 1847,
gaacagctttgtagtttgcc

SEQ ID NO: 5782 - DNA, 19 bp, Homo Sapiens
  primer_bind 1..19: upstream amplification primer 99-6866 for SEQ 1848,
gtgttgtggaatgaatgtg

SEQ ID NO: 5783 - DNA, 21 bp, Homo Sapiens
  primer_bind 1..21: upstream amplification primer 99-6869 for SEQ 1849,
gatttgataggatattggatg

SEQ ID NO: 5784 - DNA, 18 bp, Homo Sapiens
  primer_bind 1..18: upstream amplification primer 99-6876 for SEQ 1850,
cagtcctggagtcttttg

SEQ ID NO: 5785 - DNA, 19 bp, Homo Sapiens
  primer_bind 1..19: upstream amplification primer 99-689 for SEQ 1851,
tcataaaaatccccttctc

SEQ ID NO: 5786 - DNA, 18 bp, Homo Sapiens
  primer_bind 1..18: upstream amplification primer 99-6893 for SEQ 1852,
agtgacagagataggaag

SEQ ID NO: 5787 - DNA, 18 bp, Homo Sapiens
  primer_bind 1..18: upstream amplification primer 99-6895 for SEQ 1853,
caattccaaaaccacctg

SEQ ID NO: 5788 - DNA, 20 bp, Homo Sapiens
  primer_bind 1..20: upstream amplification primer 99-6938 for SEQ 1854,
tgaccgcagacaagtgctac

SEQ ID NO: 5789 - DNA, 19 bp, Homo Sapiens
  primer_bind 1..19: upstream amplification primer 99-694 for SEQ 1855,
gtaaaggcattctgtgttc

SEQ ID NO: 5790 - DNA, 18 bp, Homo Sapiens
  primer_bind 1..18: upstream amplification primer 99-6940 for SEQ 1856,
gtgagatgcgtgaaatcc

SEQ ID NO: 5791 - DNA, 18 bp, Homo Sapiens
  primer_bind 1..18: upstream amplification primer 99-6942 for SEQ 1857,
tggagaggggaagaatac

SEQ ID NO: 5792 - DNA, 18 bp, Homo Sapiens
  primer_bind 1..18: upstream amplification primer 99-6951 for SEQ 1858,
gaaacatcattcaccacc

SEQ ID NO: 5793 - DNA, 18 bp, Homo Sapiens
  primer_bind 1..18: upstream amplification primer 99-6956 for SEQ 1859,
ctcaaaacacttcccttc

SEQ ID NO: 5794 - DNA, 19 bp, Homo Sapiens
  primer_bind 1..19: upstream amplification primer 99-6957 for SEQ 1860,
tacacagacaggagcaagg

SEQ ID NO: 5795 - DNA, 19 bp, Homo Sapiens
  primer_bind 1..19: upstream amplification primer 99-6960 for SEQ 1861,
actggcatctcttgaaaac

SEQ ID NO: 5796 - DNA, 18 bp, Homo Sapiens
  primer_bind 1..18: upstream amplification primer 99-6962 for SEQ 1862,
cattgatgttctcagtcg

SEQ ID NO: 5797 - DNA, 18 bp, Homo Sapiens
  primer_bind 1..18: upstream amplification primer 99-6979 for SEQ 1863,
caagtttttcctgcttcc

SEQ ID NO: 5798 - DNA, 18 bp, Homo Sapiens
  primer_bind 1..18: upstream amplification primer 99-6986 for SEQ 1864,
gtggaataatgaaggagg

SEQ ID NO: 5799 - DNA, 20 bp, Homo Sapiens
  primer_bind 1..20: upstream amplification primer 99-6988 for SEQ 1865,
gtaatatttagaggaggaag

SEQ ID NO: 5800 - DNA, 18 bp, Homo Sapiens
  primer_bind 1..18: upstream amplification primer 99-6989 for SEQ 1866,
tgcattaattccagcagc

SEQ ID NO: 5801 - DNA, 19 bp, Homo Sapiens
  primer_bind 1..19: upstream amplification primer 99-6996 for SEQ 1867,
tttatacccttaccaactc

SEQ ID NO: 5802 - DNA, 21 bp, Homo Sapiens
  primer_bind 1..21: upstream amplification primer 99-700 for SEQ 1868,
caccaagaactaaaacttgac

SEQ ID NO: 5803 - DNA, 18 bp, Homo Sapiens
  primer_bind 1..18: upstream amplification primer 99-7000 for SEQ 1869,
cagagatgagaacagaag

SEQ ID NO: 5804 - DNA, 20 bp, Homo Sapiens
  primer_bind 1..20: upstream amplification primer 99-7004 for SEQ 1870,
acggaatgtggactacgctg

SEQ ID NO: 5805 - DNA, 20 bp, Homo Sapiens
  primer_bind 1..20: upstream amplification primer 99-7013 for SEQ 1871,
aggttgactctagtttcagg

SEQ ID NO: 5806 - DNA, 19 bp, Homo Sapiens
  primer_bind 1..19: upstream amplification primer 99-7024 for SEQ 1872,
ttaattccacccttatgac

SEQ ID NO: 5807 - DNA, 19 bp, Homo Sapiens
  primer_bind 1..19: upstream amplification primer 99-7025 for SEQ 1873,
agggagagagagaatggtg

SEQ ID NO: 5808 - DNA, 20 bp, Homo Sapiens
  primer_bind 1..20: upstream amplification primer 99-7026 for SEQ 1874,
catctttcccatttcatcag

SEQ ID NO: 5809 - DNA, 20 bp, Homo Sapiens
  primer_bind 1..20: upstream amplification primer 99-7047 for SEQ 1875,
tttcttattcttcccttctc

SEQ ID NO: 5810 - DNA, 20 bp, Homo Sapiens
  primer_bind 1..20: upstream amplification primer 99-7056 for SEQ 1876,
gtcctgctgatctttttttc

SEQ ID NO: 5811 - DNA, 21 bp, Homo Sapiens
  primer_bind 1..21: upstream amplification primer 99-708 for SEQ 1877,
gaccgataaaatttagcaaag

SEQ ID NO: 5812 - DNA, 20 bp, Homo Sapiens
  primer_bind 1..20: upstream amplification primer 99-7084 for SEQ 1878,
gttggtttttcaaatgtagc

SEQ ID NO: 5813 - DNA, 19 bp, Homo Sapiens
  primer_bind 1..19: upstream amplification primer 99-7090 for SEQ 1879,
tggcaagaacacggaagag

SEQ ID NO: 5814 - DNA, 18 bp, Homo Sapiens
  primer_bind 1..18: upstream amplification primer 99-7093 for SEQ 1880,
aaaccaaccttgcattcc

SEQ ID NO: 5815 - DNA, 18 bp, Homo Sapiens
  primer_bind 1..18: upstream amplification primer 99-7098 for SEQ 1881,
agagaaggaggaatcagg

SEQ ID NO: 5816 - DNA, 19 bp, Homo Sapiens
  primer_bind 1..19: upstream amplification primer 99-7103 for SEQ 1882,
caacatccattcctcaaac

SEQ ID NO: 5817 - DNA, 19 bp, Homo Sapiens
  primer_bind 1..19: upstream amplification primer 99-7104 for SEQ 1883,
gcctttcttttccttttcc

SEQ ID NO: 5818 - DNA, 18 bp, Homo Sapiens
  primer_bind 1..18: upstream amplification primer 99-7107 for SEQ 1884,
caaacatggaacagacag

SEQ ID NO: 5819 - DNA, 18 bp, Homo Sapiens
  primer_bind 1..18: upstream amplification primer 99-7114 for SEQ 1885,
gagaaatgtaagccagcc

SEQ ID NO: 5820 - DNA, 18 bp, Homo Sapiens
  primer_bind 1..18: upstream amplification primer 99-7119 for SEQ 1886,
gattacaaaactccagcc

SEQ ID NO: 5821 - DNA, 21 bp, Homo Sapiens
  primer_bind 1..21: upstream amplification primer 99-7129 for SEQ 1887,
tacatcaggcaagaataaatg

SEQ ID NO: 5822 - DNA, 19 bp, Homo Sapiens
  primer_bind 1..19: upstream amplification primer 99-7131 for SEQ 1888,
ttgtaattatgtcagcctc

SEQ ID NO: 5823 - DNA, 19 bp, Homo Sapiens
  primer_bind 1..19: upstream amplification primer 99-7136 for SEQ 1889,
gctcttgtttttttcactc

SEQ ID NO: 5824 - DNA, 19 bp, Homo Sapiens
  primer_bind 1..19: upstream amplification primer 99-7137 for SEQ 1890,
aaccttacatctatctctc

SEQ ID NO: 5825 - DNA, 19 bp, Homo Sapiens
  primer_bind 1..19: upstream amplification primer 99-7140 for SEQ 1891,
ctatgatgaagccatacag

SEQ ID NO: 5826 - DNA, 20 bp, Homo Sapiens
  primer_bind 1..20: upstream amplification primer 99-7141 for SEQ 1892,
aggggagttggggagaaatg

SEQ ID NO: 5827 - DNA, 21 bp, Homo Sapiens
  primer_bind 1..21: upstream amplification primer 99-7144 for SEQ 1893,
ccttaatcattccttatcttg

SEQ ID NO: 5828 - DNA, 21 bp, Homo Sapiens
  primer_bind 1..21: upstream amplification primer 99-7148 for SEQ 1894,
gtaacaaaccacagtaacatc

SEQ ID NO: 5829 - DNA, 20 bp, Homo Sapiens
  primer_bind 1..20: upstream amplification primer 99-7167 for SEQ 1895,
ctaaatggtagattaagtgg

SEQ ID NO: 5830 - DNA, 21 bp, Homo Sapiens
  primer_bind 1..21: upstream amplification primer 99-7172 for SEQ 1896,
gctctattgcttttactattc

SEQ ID NO: 5831 - DNA, 20 bp, Homo Sapiens
  primer_bind 1..20: upstream amplification primer 99-7177 for SEQ 1897,
aatcctgacccaccttctcc

SEQ ID NO: 5832 - DNA, 18 bp, Homo Sapiens
  primer_bind 1..18: upstream amplification primer 99-718 for SEQ 1898,
ggaataaagacaagggag

SEQ ID NO: 5833 - DNA, 21 bp, Homo Sapiens
  primer_bind 1..21: upstream amplification primer 99-7183 for SEQ 1899,
ttaatcgtcctccattcttcc

SEQ ID NO: 5834 - DNA, 20 bp, Homo Sapiens
  primer_bind 1..20: upstream amplification primer 99-7193 for SEQ 1900,
gaggtaaaaatagcaggcag

SEQ ID NO: 5835 - DNA, 23 bp, Homo Sapiens
  primer_bind 1..23: upstream amplification primer 99-72 for SEQ 1901,
aaagtattcctttcaccagccac

SEQ ID NO: 5836 - DNA, 20 bp, Homo Sapiens
  primer_bind 1..20: upstream amplification primer 99-7212 for SEQ 1902,
gctccttatgtaattgaatg

SEQ ID NO: 5837 - DNA, 19 bp, Homo Sapiens
  primer_bind 1..19: upstream amplification primer 99-7214 for SEQ 1903,
accatcgccattagcactc

SEQ ID NO: 5838 - DNA, 18 bp, Homo Sapiens
  primer_bind 1..18: upstream amplification primer 99-7218 for SEQ 1904,
ttcattggctgctctttc

SEQ ID NO: 5839 - DNA, 20 bp, Homo Sapiens
  primer_bind 1..20: upstream amplification primer 99-7234 for SEQ 1905,
ccccgtttgtccctgttttc

SEQ ID NO: 5840 - DNA, 18 bp, Homo Sapiens
  primer_bind 1..18: upstream amplification primer 99-724 for SEQ 1906,
tagcagtgtaagtcatgg

SEQ ID NO: 5841 - DNA, 18 bp, Homo Sapiens
  primer_bind 1..18: upstream amplification primer 99-7252 for SEQ 1907,
atatttctggtgctgctg

SEQ ID NO: 5842 - DNA, 18 bp, Homo Sapiens
  primer_bind 1..18: upstream amplification primer 99-7274 for SEQ 1908,
ggcttgcctaaaatgatg

SEQ ID NO: 5843 - DNA, 20 bp, Homo Sapiens
  primer_bind 1..20: upstream amplification primer 99-7275 for SEQ 1909,
catcataggtattcatagag

SEQ ID NO: 5844 - DNA, 18 bp, Homo Sapiens
  primer_bind 1..18: upstream amplification primer 99-7276 for SEQ 1910,
gctccatgaacttttacc

SEQ ID NO: 5845 - DNA, 19 bp, Homo Sapiens
  primer_bind 1..19: upstream amplification primer 99-7293 for SEQ 1911,
catctactccttacaaatc

SEQ ID NO: 5846 - DNA, 20 bp, Homo Sapiens
  primer_bind 1..20: upstream amplification primer 99-73 for SEQ 1912,
gtgactttgaactctctatc

SEQ ID NO: 5847 - DNA, 19 bp, Homo Sapiens
  primer_bind 1..19: upstream amplification primer 99-7311 for SEQ 1913,
ttctctctctctctttttc

SEQ ID NO: 5848 - DNA, 19 bp, Homo Sapiens
  primer_bind 1..19: upstream amplification primer 99-7312 for SEQ 1914,
tgtggatgctgacgtttgg

SEQ ID NO: 5849 - DNA, 19 bp, Homo Sapiens
  primer_bind 1..19: upstream amplification primer 99-7323 for SEQ 1915,
atgttaatagatttgcccc

SEQ ID NO: 5850 - DNA, 19 bp, Homo Sapiens
  primer_bind 1..19: upstream amplification primer 99-7326 for SEQ 1916,
aacctgaagtgattgaaag

SEQ ID NO: 5851 - DNA, 19 bp, Homo Sapiens
  primer_bind 1..19: upstream amplification primer 99-7334 for SEQ 1917,
gtttactcaggcaaaaagg

SEQ ID NO: 5852 - DNA, 19 bp, Homo Sapiens
  primer_bind 1..19: upstream amplification primer 99-734 for SEQ 1918,
gtaacagtctccagttttc

SEQ ID NO: 5853 - DNA, 20 bp, Homo Sapiens
  primer_bind 1..20: upstream amplification primer 99-7349 for SEQ 1919,
agctgctggcacttagagtc

SEQ ID NO: 5854 - DNA, 18 bp, Homo Sapiens
  primer_bind 1..18: upstream amplification primer 99-7356 for SEQ 1920,
gagccagactcacaaatg

SEQ ID NO: 5855 - DNA, 19 bp, Homo Sapiens
  primer_bind 1..19: upstream amplification primer 99-7363 for SEQ 1921,
gagaagtccaaggtcaaag

SEQ ID NO: 5856 - DNA, 20 bp, Homo Sapiens
  primer_bind 1..20: upstream amplification primer 99-737 for SEQ 1922,
gggctatgatactaataatg

SEQ ID NO: 5857 - DNA, 18 bp, Homo Sapiens
  primer_bind 1..18: upstream amplification primer 99-7373 for SEQ 1923,
gagcagagtggcataaag

SEQ ID NO: 5858 - DNA, 20 bp, Homo Sapiens
  primer_bind 1..20: upstream amplification primer 99-7374 for SEQ 1924,
aggagatgggagtgagatgg

SEQ ID NO: 5859 - DNA, 18 bp, Homo Sapiens
  primer_bind 1..18: upstream amplification primer 99-7375 for SEQ 1925,
tatacttctgactccctg

SEQ ID NO: 5860 - DNA, 21 bp, Homo Sapiens
  primer_bind 1..21: upstream amplification primer 99-7376 for SEQ 1926,
ccaatataatctttcctcaac

SEQ ID NO: 5861 - DNA, 18 bp, Homo Sapiens
  primer_bind 1..18: upstream amplification primer 99-7380 for SEQ 1927,
ttgctactgtccagtaac

SEQ ID NO: 5862 - DNA, 20 bp, Homo Sapiens
  primer_bind 1..20: upstream amplification primer 99-7387 for SEQ 1928,
acactggcaacagtctgtgg

SEQ ID NO: 5863 - DNA, 18 bp, Homo Sapiens
  primer_bind 1..18: upstream amplification primer 99-7391 for SEQ 1929,
gaaagagaagatgtctgg

SEQ ID NO: 5864 - DNA, 18 bp, Homo Sapiens
  primer_bind 1..18: upstream amplification primer 99-7396 for SEQ 1930,
ctagaaccctgaatcaag

SEQ ID NO: 5865 - DNA, 19 bp, Homo Sapiens
  primer_bind 1..19: upstream amplification primer 99-7402 for SEQ 1931,
catggtcaaatagaaatgg

SEQ ID NO: 5866 - DNA, 18 bp, Homo Sapiens
  primer_bind 1..18: upstream amplification primer 99-7405 for SEQ 1932,
agcattcttgttcacagg

SEQ ID NO: 5867 - DNA, 21 bp, Homo Sapiens
  primer_bind 1..21: upstream amplification primer 99-7406 for SEQ 1933,
cagcacttgccagaatttatg

SEQ ID NO: 5868 - DNA, 19 bp, Homo Sapiens
  primer_bind 1..19: upstream amplification primer 99-7417 for SEQ 1934,
aggatagaaggagggagag

SEQ ID NO: 5869 - DNA, 18 bp, Homo Sapiens
  primer_bind 1..18: upstream amplification primer 99-7429 for SEQ 1935,
agaaacagagcctgagag

SEQ ID NO: 5870 - DNA, 19 bp, Homo Sapiens
  primer_bind 1..19: upstream amplification primer 99-7447 for SEQ 1936,
atggggtagattatgttag

SEQ ID NO: 5871 - DNA, 18 bp, Homo Sapiens
  primer_bind 1..18: upstream amplification primer 99-7453 for SEQ 1937,
atttcagagagggcaaac

SEQ ID NO: 5872 - DNA, 18 bp, Homo Sapiens
  primer_bind 1..18: upstream amplification primer 99-7454 for SEQ 1938,
ttgagaggtaagagaggg

SEQ ID NO: 5873 - DNA, 18 bp, Homo Sapiens
  primer_bind 1..18: upstream amplification primer 99-747 for SEQ 1939,
aagtgagatggaggattg

SEQ ID NO: 5874 - DNA, 18 bp, Homo Sapiens
  primer_bind 1..18: upstream amplification primer 99-7475 for SEQ 1940,
tcatttctctctctccac

SEQ ID NO: 5875 - DNA, 18 bp, Homo Sapiens
  primer_bind 1..18: upstream amplification primer 99-7480 for SEQ 1941,
ctaaacctagagcaggac

SEQ ID NO: 5876 - DNA, 18 bp, Homo Sapiens
  primer_bind 1..18: upstream amplification primer 99-7492 for SEQ 1942,
cctcaaccaccattacac

SEQ ID NO: 5877 - DNA, 19 bp, Homo Sapiens
  primer_bind 1..19: upstream amplification primer 99-7493 for SEQ 1943,
gtggaaagaaactgggttg

SEQ ID NO: 5878 - DNA, 18 bp, Homo Sapiens
  primer_bind 1..18: upstream amplification primer 99-7502 for SEQ 1944,
ataaagggcgaatggtgg

SEQ ID NO: 5879 - DNA, 19 bp, Homo Sapiens
  primer_bind 1..19: upstream amplification primer 99-7504 for SEQ 1945,
acaaaaagaacccccaaac

SEQ ID NO: 5880 - DNA, 19 bp, Homo Sapiens
  primer_bind 1..19: upstream amplification primer 99-7520 for SEQ 1946,
atctgtattgcagtaagtc

SEQ ID NO: 5881 - DNA, 20 bp, Homo Sapiens
  primer_bind 1..20: upstream amplification primer 99-7524 for SEQ 1947,
gatgtgatgaaattcaactc

SEQ ID NO: 5882 - DNA, 18 bp, Homo Sapiens
  primer_bind 1..18: upstream amplification primer 99-7543 for SEQ 1948,
cactttgtaagtgcagag

SEQ ID NO: 5883 - DNA, 18 bp, Homo Sapiens
  primer_bind 1..18: upstream amplification primer 99-755 for SEQ 1949,
tgggagcaagatgaaagg

SEQ ID NO: 5884 - DNA, 19 bp, Homo Sapiens
  primer_bind 1..19: upstream amplification primer 99-7598 for SEQ 1950,
gtcgatcttttgtgaaagc

SEQ ID NO: 5885 - DNA, 19 bp, Homo Sapiens
  primer_bind 1..19: upstream amplification primer 99-760 for SEQ 1951,
aatgctgcaaacatgctac

SEQ ID NO: 5886 - DNA, 19 bp, Homo Sapiens
  primer_bind 1..19: upstream amplification primer 99-7604 for SEQ 1952,
cacatttctcctcacaaag

SEQ ID NO: 5887 - DNA, 19 bp, Homo Sapiens
  primer_bind 1..19: upstream amplification primer 99-7605 for SEQ 1953,
atctcagtcctctgggttc

SEQ ID NO: 5888 - DNA, 20 bp, Homo Sapiens
  primer_bind 1..20: upstream amplification primer 99-7608 for SEQ 1954,
gatttacacatacacaggag

SEQ ID NO: 5889 - DNA, 18 bp, Homo Sapiens
  primer_bind 1..18: upstream amplification primer 99-7610 for SEQ 1955,
ctggtgtctggttatttc

SEQ ID NO: 5890 - DNA, 19 bp, Homo Sapiens
  primer_bind 1..19: upstream amplification primer 99-7611 for SEQ 1956,
tagaaactactcctaaacc

SEQ ID NO: 5891 - DNA, 19 bp, Homo Sapiens
  primer_bind 1..19: upstream amplification primer 99-7614 for SEQ 1957,
gtgcccctgttttttttcc

SEQ ID NO: 5892 - DNA, 21 bp, Homo Sapiens
  primer_bind 1..21: upstream amplification primer 99-763 for SEQ 1958,
aaatcagttttcaagatcagg

SEQ ID NO: 5893 - DNA, 18 bp, Homo Sapiens
  primer_bind 1..18: upstream amplification primer 99-7642 for SEQ 1959,
gacctctgccaataatac

SEQ ID NO: 5894 - DNA, 20 bp, Homo Sapiens
  primer_bind 1..20: upstream amplification primer 99-7643 for SEQ 1960,
ctagaaaggagtagattatg

SEQ ID NO: 5895 - DNA, 19 bp, Homo Sapiens
  primer_bind 1..19: upstream amplification primer 99-7650 for SEQ 1961,
atgttcagggggatgtcag

SEQ ID NO: 5896 - DNA, 19 bp, Homo Sapiens
  primer_bind 1..19: upstream amplification primer 99-7671 for SEQ 1962,
aagccacccgttacctttg

SEQ ID NO: 5897 - DNA, 19 bp, Homo Sapiens
  primer_bind 1..19: upstream amplification primer 99-7677 for SEQ 1963,
ttgttctggctctcccttc

SEQ ID NO: 5898 - DNA, 19 bp, Homo Sapiens
  primer_bind 1..19: upstream amplification primer 99-7688 for SEQ 1964,
accccttttctcatattac

SEQ ID NO: 5899 - DNA, 19 bp, Homo Sapiens
  primer_bind 1..19: upstream amplification primer 99-7692 for SEQ 1965,
tttatgccaactattccag

SEQ ID NO: 5900 - DNA, 20 bp, Homo Sapiens
  primer_bind 1..20: upstream amplification primer 99-77 for SEQ 1966,
tggggggaatgtcctaacac

SEQ ID NO: 5901 - DNA, 20 bp, Homo Sapiens
  primer_bind 1..20: upstream amplification primer 99-7706 for SEQ 1967,
taatagtggcagagggtggg

SEQ ID NO: 5902 - DNA, 19 bp, Homo Sapiens
  primer_bind 1..19: upstream amplification primer 99-771 for SEQ 1968,
tatctgcacttgcatatac

SEQ ID NO: 5903 - DNA, 18 bp, Homo Sapiens
  primer_bind 1..18: upstream amplification primer 99-7710 for SEQ 1969,
ctcagtgtctccatttac

SEQ ID NO: 5904 - DNA, 19 bp, Homo Sapiens
  primer_bind 1..19: upstream amplification primer 99-7712 for SEQ 1970,
ctcacctccaaaaaatccc

SEQ ID NO: 5905 - DNA, 20 bp, Homo Sapiens
  primer_bind 1..20: upstream amplification primer 99-7721 for SEQ 1971,
gaaaacttcttcatccagac

SEQ ID NO: 5906 - DNA, 20 bp, Homo Sapiens
  primer_bind 1..20: upstream amplification primer 99-7727 for SEQ 1972,
cagtatttcacattggcaag

SEQ ID NO: 5907 - DNA, 18 bp, Homo Sapiens
  primer_bind 1..18: upstream amplification primer 99-7728 for SEQ 1973,
ttcagcctttttgcttcc

SEQ ID NO: 5908 - DNA, 18 bp, Homo Sapiens
  primer_bind 1..18: upstream amplification primer 99-7732 for SEQ 1974,
acccactttaatgacctg

SEQ ID NO: 5909 - DNA, 19 bp, Homo Sapiens
  primer_bind 1..19: upstream amplification primer 99-7737 for SEQ 1975,
tgtgcgtgtactatttttc

SEQ ID NO: 5910 - DNA, 18 bp, Homo Sapiens
  primer_bind 1..18: upstream amplification primer 99-7744 for SEQ 1976,
gtcttaccaaagcagttc

SEQ ID NO: 5911 - DNA, 18 bp, Homo Sapiens
  primer_bind 1..18: upstream amplification primer 99-7745 for SEQ 1977,
gggctctaatgttattgg

SEQ ID NO: 5912 - DNA, 18 bp, Homo Sapiens
  primer_bind 1..18: upstream amplification primer 99-7749 for SEQ 1978,
aaagtgtgaggttgtggg

SEQ ID NO: 5913 - DNA, 19 bp, Homo Sapiens
  primer_bind 1..19: upstream amplification primer 99-7751 for SEQ 1979,
tgtgtgggtttttgttttg

SEQ ID NO: 5914 - DNA, 18 bp, Homo Sapiens
  primer_bind 1..18: upstream amplification primer 99-7753 for SEQ 1980,
ctgttactgtggactatg

SEQ ID NO: 5915 - DNA, 18 bp, Homo Sapiens
  primer_bind 1..18: upstream amplification primer 99-7754 for SEQ 1981,
gaaatgagggaagtaagg

SEQ ID NO: 5916 - DNA, 18 bp, Homo Sapiens
  primer_bind 1..18: upstream amplification primer 99-7759 for SEQ 1982,
agagagacaactgttgac

SEQ ID NO: 5917 - DNA, 18 bp, Homo Sapiens
  primer_bind 1..18: upstream amplification primer 99-7762 for SEQ 1983,
ttttgggatgctggatgg

SEQ ID NO: 5918 - DNA, 20 bp, Homo Sapiens
  primer_bind 1..20: upstream amplification primer 99-7764 for SEQ 1984,
cagaaacacaaaacatacag

SEQ ID NO: 5919 - DNA, 18 bp, Homo Sapiens
  primer_bind 1..18: upstream amplification primer 99-7775 for SEQ 1985,
cctcttgccttttctctc

SEQ ID NO: 5920 - DNA, 19 bp, Homo Sapiens
  primer_bind 1..19: upstream amplification primer 99-7784 for SEQ 1986,
ctttacttctggctgcaac

SEQ ID NO: 5921 - DNA, 18 bp, Homo Sapiens
  primer_bind 1..18: upstream amplification primer 99-7789 for SEQ 1987,
acaggaagaagcaggaac

SEQ ID NO: 5922 - DNA, 18 bp, Homo Sapiens
  primer_bind 1..18: upstream amplification primer 99-7792 for SEQ 1988,
tggaagggagggataaag

SEQ ID NO: 5923 - DNA, 18 bp, Homo Sapiens
  primer_bind 1..18: upstream amplification primer 99-7796 for SEQ 1989,
agcactgttccttcttcc

SEQ ID NO: 5924 - DNA, 20 bp, Homo Sapiens
  primer_bind 1..20: upstream amplification primer 99-7803 for SEQ 1990,
gaaggggtaatgatacttag

SEQ ID NO: 5925 - DNA, 18 bp, Homo Sapiens
  primer_bind 1..18: upstream amplification primer 99-781 for SEQ 1991,
cctcactaaactaccttc

SEQ ID NO: 5926 - DNA, 20 bp, Homo Sapiens
  primer_bind 1..20: upstream amplification primer 99-7840 for SEQ 1992,
cttgattattcacagagaac

SEQ ID NO: 5927 - DNA, 18 bp, Homo Sapiens
  primer_bind 1..18: upstream amplification primer 99-785 for SEQ 1993,
ggtgccaggtataatgag

SEQ ID NO: 5928 - DNA, 19 bp, Homo Sapiens
  primer_bind 1..19: upstream amplification primer 99-7868 for SEQ 1994,
ccttctcattattgtcctc

SEQ ID NO: 5929 - DNA, 21 bp, Homo Sapiens
  primer_bind 1..21: upstream amplification primer 99-7869 for SEQ 1995,
gaaataacttctaggaacttc

SEQ ID NO: 5930 - DNA, 19 bp, Homo Sapiens
  primer_bind 1..19: upstream amplification primer 99-7870 for SEQ 1996,
ataagagaagtttgcttgg

SEQ ID NO: 5931 - DNA, 19 bp, Homo Sapiens
  primer_bind 1..19: upstream amplification primer 99-7877 for SEQ 1997,
tcctatttcttactactcc

SEQ ID NO: 5932 - DNA, 19 bp, Homo Sapiens
  primer_bind 1..19: upstream amplification primer 99-7882 for SEQ 1998,
gatgtgttaagaagggatg

SEQ ID NO: 5933 - DNA, 20 bp, Homo Sapiens
  primer_bind 1..20: upstream amplification primer 99-7883 for SEQ 1999,
cagggtgagagaaagaacag

SEQ ID NO: 5934 - DNA, 19 bp, Homo Sapiens
  primer_bind 1..19: upstream amplification primer 99-7884 for SEQ 2000,
aacattcccacaatattcc

SEQ ID NO: 5935 - DNA, 19 bp, Homo Sapiens
  primer_bind 1..19: upstream amplification primer 99-7893 for SEQ 2001,
ccaaagaaacaaaagacag

SEQ ID NO: 5936 - DNA, 19 bp, Homo Sapiens
  primer_bind 1..19: upstream amplification primer 99-7898 for SEQ 2002,
ccattcacatttcaacacc

SEQ ID NO: 5937 - DNA, 19 bp, Homo Sapiens
  primer_bind 1..19: upstream amplification primer 99-7900 for SEQ 2003,
gctttacttggcgagtttg

SEQ ID NO: 5938 - DNA, 18 bp, Homo Sapiens
  primer_bind 1..18: upstream amplification primer 99-791 for SEQ 2004,
tctagtgtcacatcaacc

SEQ ID NO: 5939 - DNA, 18 bp, Homo Sapiens
  primer_bind 1..18: upstream amplification primer 99-7917 for SEQ 2005,
gaccactggaaactaaac

SEQ ID NO: 5940 - DNA, 18 bp, Homo Sapiens
  primer_bind 1..18: upstream amplification primer 99-794 for SEQ 2006,
accctgtgatttgaaccc

SEQ ID NO: 5941 - DNA, 20 bp, Homo Sapiens
  primer_bind 1..20: upstream amplification primer 99-7949 for SEQ 2007,
cacttaaattcccctttatc

SEQ ID NO: 5942 - DNA, 18 bp, Homo Sapiens
  primer_bind 1..18: upstream amplification primer 99-795 for SEQ 2008,
gggagttagattgccttg

SEQ ID NO: 5943 - DNA, 18 bp, Homo Sapiens
  primer_bind 1..18: upstream amplification primer 99-7967 for SEQ 2009,
ataggaagatagggatgg

SEQ ID NO: 5944 - DNA, 19 bp, Homo Sapiens
  primer_bind 1..19: upstream amplification primer 99-797 for SEQ 2010,
gagtcaacaaaacaatctg

SEQ ID NO: 5945 - DNA, 19 bp, Homo Sapiens
  primer_bind 1..19: upstream amplification primer 99-7985 for SEQ 2011,
aaagcgattcagccttccc

SEQ ID NO: 5946 - DNA, 19 bp, Homo Sapiens
  primer_bind 1..19: upstream amplification primer 99-7988 for SEQ 2012,
tgacagcagagtgttaaag

SEQ ID NO: 5947 - DNA, 18 bp, Homo Sapiens
  primer_bind 1..18: upstream amplification primer 99-8002 for SEQ 2013,
gagaaacccctcgttttg

SEQ ID NO: 5948 - DNA, 19 bp, Homo Sapiens
  primer_bind 1..19: upstream amplification primer 99-8010 for SEQ 2014,
tgatgagacagaaactaag

SEQ ID NO: 5949 - DNA, 18 bp, Homo Sapiens
  primer_bind 1..18: upstream amplification primer 99-8012 for SEQ 2015,
accttccttccttctaac

SEQ ID NO: 5950 - DNA, 18 bp, Homo Sapiens
  primer_bind 1..18: upstream amplification primer 99-8013 for SEQ 2016,
catcacttatcaccactg

SEQ ID NO: 5951 - DNA, 18 bp, Homo Sapiens
  primer_bind 1..18: upstream amplification primer 99-8016 for SEQ 2017,
tccaatcctcaaccatcc

SEQ ID NO: 5952 - DNA, 18 bp, Homo Sapiens
  primer_bind 1..18: upstream amplification primer 99-8025 for SEQ 2018,
caactggttacaatgctc

SEQ ID NO: 5953 - DNA, 18 bp, Homo Sapiens
  primer_bind 1..18: upstream amplification primer 99-8027 for SEQ 2019,
gaaccaagaaacccacag

SEQ ID NO: 5954 - DNA, 18 bp, Homo Sapiens
  primer_bind 1..18: upstream amplification primer 99-8028 for SEQ 2020,
cacccttttctccatttc

SEQ ID NO: 5955 - DNA, 18 bp, Homo Sapiens
  primer_bind 1..18: upstream amplification primer 99-8030 for SEQ 2021,
aaattttctgggctgctc

SEQ ID NO: 5956 - DNA, 19 bp, Homo Sapiens
  primer_bind 1..19: upstream amplification primer 99-8046 for SEQ 2022,
gaccatgacatattgaaag

SEQ ID NO: 5957 - DNA, 18 bp, Homo Sapiens
  primer_bind 1..18: upstream amplification primer 99-8051 for SEQ 2023,
tggagtggtgggtaaatg

SEQ ID NO: 5958 - DNA, 19 bp, Homo Sapiens
  primer_bind 1..19: upstream amplification primer 99-806 for SEQ 2024,
accaagaaatcttgaatcc

SEQ ID NO: 5959 - DNA, 19 bp, Homo Sapiens
  primer_bind 1..19: upstream amplification primer 99-8063 for SEQ 2025,
gcttcagatgaaaaggctc

SEQ ID NO: 5960 - DNA, 20 bp, Homo Sapiens
  primer_bind 1..20: upstream amplification primer 99-8067 for SEQ 2026,
tggagagcaatggcagacag

SEQ ID NO: 5961 - DNA, 20 bp, Homo Sapiens
  primer_bind 1..20: upstream amplification primer 99-8068 for SEQ 2027,
ggaataacagagacatctgg

SEQ ID NO: 5962 - DNA, 21 bp, Homo Sapiens
  primer_bind 1..21: upstream amplification primer 99-8081 for SEQ 2028,
ctattagatagattattgggg

SEQ ID NO: 5963 - DNA, 19 bp, Homo Sapiens
  primer_bind 1..19: upstream amplification primer 99-8088 for SEQ 2029,
attaaagcattacctctcc

SEQ ID NO: 5964 - DNA, 18 bp, Homo Sapiens
  primer_bind 1..18: upstream amplification primer 99-8089 for SEQ 2030,
ctgtgttgagtgcttagg

SEQ ID NO: 5965 - DNA, 19 bp, Homo Sapiens
  primer_bind 1..19: upstream amplification primer 99-8095 for SEQ 2031,
cttcagttggcataatgtg

SEQ ID NO: 5966 - DNA, 18 bp, Homo Sapiens
  primer_bind 1..18: upstream amplification primer 99-81 for SEQ 2032,
gaatgcttgctgtgcttg

SEQ ID NO: 5967 - DNA, 19 bp, Homo Sapiens
  primer_bind 1..19: upstream amplification primer 99-810 for SEQ 2033,
ctatccacctacaaacttc

SEQ ID NO: 5968 - DNA, 19 bp, Homo Sapiens
  primer_bind 1..19: upstream amplification primer 99-8102 for SEQ 2034,
ttgcatgaaacaaaaggac

SEQ ID NO: 5969 - DNA, 20 bp, Homo Sapiens
  primer_bind 1..20: upstream amplification primer 99-8120 for SEQ 2035,
ggaatagtgtggcaataaag

SEQ ID NO: 5970 - DNA, 18 bp, Homo Sapiens
  primer_bind 1..18: upstream amplification primer 99-8128 for SEQ 2036,
gataagaggaggataagg

SEQ ID NO: 5971 - DNA, 19 bp, Homo Sapiens
  primer_bind 1..19: upstream amplification primer 99-8141 for SEQ 2037,
aatacttatcatctgaccc

SEQ ID NO: 5972 - DNA, 20 bp, Homo Sapiens
  primer_bind 1..20: upstream amplification primer 99-8161 for SEQ 2038,
aggagatgggagtgagatgg

SEQ ID NO: 5973 - DNA, 18 bp, Homo Sapiens
  primer_bind 1..18: upstream amplification primer 99-8162 for SEQ 2039,
tatacttctgactccctg

SEQ ID NO: 5974 - DNA, 21 bp, Homo Sapiens
  primer_bind 1..21: upstream amplification primer 99-8164 for SEQ 2040,
ccaatataatctttcctcaac

SEQ ID NO: 5975 - DNA, 18 bp, Homo Sapiens
  primer_bind 1..18: upstream amplification primer 99-8170 for SEQ 2041,
aataagttttgggggtgg

SEQ ID NO: 5976 - DNA, 19 bp, Homo Sapiens
  primer_bind 1..19: upstream amplification primer 99-8173 for SEQ 2042,
gattttgactctcttcacc

SEQ ID NO: 5977 - DNA, 18 bp, Homo Sapiens
  primer_bind 1..18: upstream amplification primer 99-8181 for SEQ 2043,
ctagaaccctgaatcaag

SEQ ID NO: 5978 - DNA, 19 bp, Homo Sapiens
  primer_bind 1..19: upstream amplification primer 99-8186 for SEQ 2044,
catggtcaaatagaaatgg

SEQ ID NO: 5979 - DNA, 18 bp, Homo Sapiens
  primer_bind 1..18: upstream amplification primer 99-8188 for SEQ 2045,
tggctttcctgtaagttc

SEQ ID NO: 5980 - DNA, 18 bp, Homo Sapiens
  primer_bind 1..18: upstream amplification primer 99-8192 for SEQ 2046,
cagaagccagaaagagac

SEQ ID NO: 5981 - DNA, 21 bp, Homo Sapiens
  primer_bind 1..21: upstream amplification primer 99-8219 for SEQ 2047,
caaactttcaaatccatatcc

SEQ ID NO: 5982 - DNA, 18 bp, Homo Sapiens
  primer_bind 1..18: upstream amplification primer 99-8245 for SEQ 2048,
catcttgctaatagtgcc

SEQ ID NO: 5983 - DNA, 18 bp, Homo Sapiens
  primer_bind 1..18: upstream amplification primer 99-8255 for SEQ 2049,
tgtctgtccttgagactg

SEQ ID NO: 5984 - DNA, 18 bp, Homo Sapiens
  primer_bind 1..18: upstream amplification primer 99-8256 for SEQ 2050,
aagcctcagttccttatc

SEQ ID NO: 5985 - DNA, 18 bp, Homo Sapiens
  primer_bind 1..18: upstream amplification primer 99-8266 for SEQ 2051,
gttggtaaaggaataggg

SEQ ID NO: 5986 - DNA, 18 bp, Homo Sapiens
  primer_bind 1..18: upstream amplification primer 99-827 for SEQ 2052,
ccctgtgaactgtatttg

SEQ ID NO: 5987 - DNA, 20 bp, Homo Sapiens
  primer_bind 1..20: upstream amplification primer 99-8272 for SEQ 2053,
gcactttagtgttctgaatc

SEQ ID NO: 5988 - DNA, 18 bp, Homo Sapiens
  primer_bind 1..18: upstream amplification primer 99-8276 for SEQ 2054,
aactgaggtctgtttgtg

SEQ ID NO: 5989 - DNA, 19 bp, Homo Sapiens
  primer_bind 1..19: upstream amplification primer 99-8278 for SEQ 2055,
ctgaataaatggagaactg

SEQ ID NO: 5990 - DNA, 19 bp, Homo Sapiens
  primer_bind 1..19: upstream amplification primer 99-8279 for SEQ 2056,
gactaatgggggaaaaaac

SEQ ID NO: 5991 - DNA, 18 bp, Homo Sapiens
  primer_bind 1..18: upstream amplification primer 99-828 for SEQ 2057,
gcctctttgctatgaaac

SEQ ID NO: 5992 - DNA, 20 bp, Homo Sapiens
  primer_bind 1..20: upstream amplification primer 99-8287 for SEQ 2058,
tgaagggaagaacggggaag

SEQ ID NO: 5993 - DNA, 19 bp, Homo Sapiens
  primer_bind 1..19: upstream amplification primer 99-8289 for SEQ 2059,
tggtatttacttcatcagg

SEQ ID NO: 5994 - DNA, 18 bp, Homo Sapiens
  primer_bind 1..18: upstream amplification primer 99-8290 for SEQ 2060,
tctctaaaggagcaggtc

SEQ ID NO: 5995 - DNA, 19 bp, Homo Sapiens
  primer_bind 1..19: upstream amplification primer 99-8292 for SEQ 2061,
ttgatgctccccttttgcc

SEQ ID NO: 5996 - DNA, 19 bp, Homo Sapiens
  primer_bind 1..19: upstream amplification primer 99-8294 for SEQ 2062,
gctacagctatgaaaagag

SEQ ID NO: 5997 - DNA, 18 bp, Homo Sapiens
  primer_bind 1..18: upstream amplification primer 99-8308 for SEQ 2063,
tgtgagagtaggacagag

SEQ ID NO: 5998 - DNA, 18 bp, Homo Sapiens
  primer_bind 1..18: upstream amplification primer 99-8313 for SEQ 2064,
aattccagcacattccac

SEQ ID NO: 5999 - DNA, 19 bp, Homo Sapiens
  primer_bind 1..19: upstream amplification primer 99-8318 for SEQ 2065,
actaaccactataaagacc

SEQ ID NO: 6000 - DNA, 20 bp, Homo Sapiens
  primer_bind 1..20: upstream amplification primer 99-8328 for SEQ 2066,
gaaaaataggtgaagtgatg

SEQ ID NO: 6001 - DNA, 20 bp, Homo Sapiens
  primer_bind 1..20: upstream amplification primer 99-8338 for SEQ 2067,
ggcactttccattctaattc

SEQ ID NO: 6002 - DNA, 20 bp, Homo Sapiens
  primer_bind 1..20: upstream amplification primer 99-8340 for SEQ 2068,
gtggataatttactgacagg

SEQ ID NO: 6003 - DNA, 19 bp, Homo Sapiens
  primer_bind 1..19: upstream amplification primer 99-8341 for SEQ 2069,
gtgaagtatgtaaacaagg

SEQ ID NO: 6004 - DNA, 19 bp, Homo Sapiens
  primer_bind 1..19: upstream amplification primer 99-8342 for SEQ 2070,
agaactagaagagttttcc

SEQ ID NO: 6005 - DNA, 19 bp, Homo Sapiens
  primer_bind 1..19: upstream amplification primer 99-8353 for SEQ 2071,
gctactctaaaagacaacc

SEQ ID NO: 6006 - DNA, 18 bp, Homo Sapiens
  primer_bind 1..18: upstream amplification primer 99-8360 for SEQ 2072,
tttcccccacaaaacaac

SEQ ID NO: 6007 - DNA, 19 bp, Homo Sapiens
  primer_bind 1..19: upstream amplification primer 99-8361 for SEQ 2073,
agctagatcccagttagcc

SEQ ID NO: 6008 - DNA, 18 bp, Homo Sapiens
  primer_bind 1..18: upstream amplification primer 99-8367 for SEQ 2074,
catccactccttcttctc

SEQ ID NO: 6009 - DNA, 18 bp, Homo Sapiens
  primer_bind 1..18: upstream amplification primer 99-8369 for SEQ 2075,
ttcatgtgccgttttgag

SEQ ID NO: 6010 - DNA, 20 bp, Homo Sapiens
  primer_bind 1..20: upstream amplification primer 99-8377 for SEQ 2076,
gagagagatttcttacgatg

SEQ ID NO: 6011 - DNA, 18 bp, Homo Sapiens
  primer_bind 1..18: upstream amplification primer 99-8378 for SEQ 2077,
gcagcatcattttgcttg

SEQ ID NO: 6012 - DNA, 19 bp, Homo Sapiens
  primer_bind 1..19: upstream amplification primer 99-8379 for SEQ 2078,
actattcttgactttccag

SEQ ID NO: 6013 - DNA, 18 bp, Homo Sapiens
  primer_bind 1..18: upstream amplification primer 99-8381 for SEQ 2079,
atcaattcacacggcacc

SEQ ID NO: 6014 - DNA, 18 bp, Homo Sapiens
  primer_bind 1..18: upstream amplification primer 99-8383 for SEQ 2080,
acctacacaatttccctc

SEQ ID NO: 6015 - DNA, 18 bp, Homo Sapiens
  primer_bind 1..18: upstream amplification primer 99-8385 for SEQ 2081,
tctacgaagcagacagac

SEQ ID NO: 6016 - DNA, 18 bp, Homo Sapiens
  primer_bind 1..18: upstream amplification primer 99-840 for SEQ 2082,
aggaggagaaaaatggag

SEQ ID NO: 6017 - DNA, 20 bp, Homo Sapiens
  primer_bind 1..20: upstream amplification primer 99-8402 for SEQ 2083,
ggttgttgggaaaacaatac

SEQ ID NO: 6018 - DNA, 21 bp, Homo Sapiens
  primer_bind 1..21: upstream amplification primer 99-8414 for SEQ 2084,
ctgacacaaaatatgtatgag

SEQ ID NO: 6019 - DNA, 21 bp, Homo Sapiens
  primer_bind 1..21: upstream amplification primer 99-8441 for SEQ 2085,
ccatcaaaaatatcttcagac

SEQ ID NO: 6020 - DNA, 20 bp, Homo Sapiens
  primer_bind 1..20: upstream amplification primer 99-8442 for SEQ 2086,
ttagaggtcacaggcaacac

SEQ ID NO: 6021 - DNA, 21 bp, Homo Sapiens
  primer_bind 1..21: upstream amplification primer 99-8453 for SEQ 2087,
ccttcactcatcccagttttc

SEQ ID NO: 6022 - DNA, 18 bp, Homo Sapiens
  primer_bind 1..18: upstream amplification primer 99-8454 for SEQ 2088,
aggtcttctcactttctc

SEQ ID NO: 6023 - DNA, 18 bp, Homo Sapiens
  primer_bind 1..18: upstream amplification primer 99-8456 for SEQ 2089,
taagcaacagtgtcagtc

SEQ ID NO: 6024 - DNA, 18 bp, Homo Sapiens
  primer_bind 1..18: upstream amplification primer 99-8457 for SEQ 2090,
gagaatgcaacatggagg

SEQ ID NO: 6025 - DNA, 18 bp, Homo Sapiens
  primer_bind 1..18: upstream amplification primer 99-8470 for SEQ 2091,
ccctcatttctccttatc

SEQ ID NO: 6026 - DNA, 18 bp, Homo Sapiens
  primer_bind 1..18: upstream amplification primer 99-8472 for SEQ 2092,
agatccacaaggtaggac

SEQ ID NO: 6027 - DNA, 21 bp, Homo Sapiens
  primer_bind 1..21: upstream amplification primer 99-8476 for SEQ 2093,
ggaataaaactggaaatcagg

SEQ ID NO: 6028 - DNA, 19 bp, Homo Sapiens
  primer_bind 1..19: upstream amplification primer 99-8478 for SEQ 2094,
acctataaacaccatctac

SEQ ID NO: 6029 - DNA, 20 bp, Homo Sapiens
  primer_bind 1..20: upstream amplification primer 99-8487 for SEQ 2095,
tcgttttcctgttttctttg

SEQ ID NO: 6030 - DNA, 20 bp, Homo Sapiens
  primer_bind 1..20: upstream amplification primer 99-8491 for SEQ 2096,
acaacaaaatgtttcccatc

SEQ ID NO: 6031 - DNA, 18 bp, Homo Sapiens
  primer_bind 1..18: upstream amplification primer 99-8499 for SEQ 2097,
gatgattcagagtcaggc

SEQ ID NO: 6032 - DNA, 21 bp, Homo Sapiens
  primer_bind 1..21: upstream amplification primer 99-8505 for SEQ 2098,
ttctctatcttcctcctggtc

SEQ ID NO: 6033 - DNA, 18 bp, Homo Sapiens
  primer_bind 1..18: upstream amplification primer 99-851 for SEQ 2099,
aagttccttcctgtcttg

SEQ ID NO: 6034 - DNA, 20 bp, Homo Sapiens
  primer_bind 1..20: upstream amplification primer 99-8510 for SEQ 2100,
tggaagtggggtggaatctc

SEQ ID NO: 6035 - DNA, 20 bp, Homo Sapiens
  primer_bind 1..20: upstream amplification primer 99-8514 for SEQ 2101,
gtctctctctcttttagtcc

SEQ ID NO: 6036 - DNA, 20 bp, Homo Sapiens
  primer_bind 1..20: upstream amplification primer 99-8530 for SEQ 2102,
aagaacgcaagcggctctac

SEQ ID NO: 6037 - DNA, 19 bp, Homo Sapiens
  primer_bind 1..19: upstream amplification primer 99-854 for SEQ 2103,
accattatttaccacagtc

SEQ ID NO: 6038 - DNA, 19 bp, Homo Sapiens
  primer_bind 1..19: upstream amplification primer 99-8546 for SEQ 2104,
actttcttttggtttcctc

SEQ ID NO: 6039 - DNA, 18 bp, Homo Sapiens
  primer_bind 1..18: upstream amplification primer 99-8571 for SEQ 2105,
atgtggataagagaggag

SEQ ID NO: 6040 - DNA, 18 bp, Homo Sapiens
  primer_bind 1..18: upstream amplification primer 99-8575 for SEQ 2106,
taagccatcacttaggac

SEQ ID NO: 6041 - DNA, 18 bp, Homo Sapiens
  primer_bind 1..18: upstream amplification primer 99-8576 for SEQ 2107,
aaatctcaacccccactc

SEQ ID NO: 6042 - DNA, 18 bp, Homo Sapiens
  primer_bind 1..18: upstream amplification primer 99-8578 for SEQ 2108,
tgattgccaaatgcagcc

SEQ ID NO: 6043 - DNA, 19 bp, Homo Sapiens
  primer_bind 1..19: upstream amplification primer 99-8581 for SEQ 2109,
gactttcttactttgtggg

SEQ ID NO: 6044 - DNA, 18 bp, Homo Sapiens
  primer_bind 1..18: upstream amplification primer 99-8583 for SEQ 2110,
ggttctacgtttgtctgg

SEQ ID NO: 6045 - DNA, 18 bp, Homo Sapiens
  primer_bind 1..18: upstream amplification primer 99-8588 for SEQ 2111,
aatggtgtgagactcttg

SEQ ID NO: 6046 - DNA, 19 bp, Homo Sapiens
  primer_bind 1..19: upstream amplification primer 99-8590 for SEQ 2112,
atgaaaagggacagttaag

SEQ ID NO: 6047 - DNA, 18 bp, Homo Sapiens
  primer_bind 1..18: upstream amplification primer 99-860 for SEQ 2113,
caaataccccccatcatc

SEQ ID NO: 6048 - DNA, 18 bp, Homo Sapiens
  primer_bind 1..18: upstream amplification primer 99-8600 for SEQ 2114,
agtttctgggagagttgg

SEQ ID NO: 6049 - DNA, 18 bp, Homo Sapiens
  primer_bind 1..18: upstream amplification primer 99-8609 for SEQ 2115,
gcctgaatctgttttgcc

SEQ ID NO: 6050 - DNA, 19 bp, Homo Sapiens
  primer_bind 1..19: upstream amplification primer 99-8611 for SEQ 2116,
ggaaatgctgctaaagtgg

SEQ ID NO: 6051 - DNA, 18 bp, Homo Sapiens
  primer_bind 1..18: upstream amplification primer 99-862 for SEQ 2117,
tattcaagagggcaagac

SEQ ID NO: 6052 - DNA, 18 bp, Homo Sapiens
  primer_bind 1..18: upstream amplification primer 99-8626 for SEQ 2118,
cctccaatctccaacttc

SEQ ID NO: 6053 - DNA, 18 bp, Homo Sapiens
  primer_bind 1..18: upstream amplification primer 99-8632 for SEQ 2119,
ccaatccataacatgccc

SEQ ID NO: 6054 - DNA, 18 bp, Homo Sapiens
  primer_bind 1..18: upstream amplification primer 99-8638 for SEQ 2120,
gagaagagaaagaggaag

SEQ ID NO: 6055 - DNA, 18 bp, Homo Sapiens
  primer_bind 1..18: upstream amplification primer 99-8641 for SEQ 2121,
attcttcctttcctccac

SEQ ID NO: 6056 - DNA, 20 bp, Homo Sapiens
  primer_bind 1..20: upstream amplification primer 99-8648 for SEQ 2122,
gacaactttttaggtatagg

SEQ ID NO: 6057 - DNA, 19 bp, Homo Sapiens
  primer_bind 1..19: upstream amplification primer 99-8654 for SEQ 2123,
tttgactatgccttttgac

SEQ ID NO: 6058 - DNA, 19 bp, Homo Sapiens
  primer_bind 1..19: upstream amplification primer 99-8655 for SEQ 2124,
cacacattttgcctgtttg

SEQ ID NO: 6059 - DNA, 19 bp, Homo Sapiens
  primer_bind 1..19: upstream amplification primer 99-8658 for SEQ 2125,
caaaatcaataccccaatc

SEQ ID NO: 6060 - DNA, 18 bp, Homo Sapiens
  primer_bind 1..18: upstream amplification primer 99-866 for SEQ 2126,
ctgtgctgatcctgtctg

SEQ ID NO: 6061 - DNA, 19 bp, Homo Sapiens
  primer_bind 1..19: upstream amplification primer 99-8662 for SEQ 2127,
cttaaaaacacacacagcc

SEQ ID NO: 6062 - DNA, 18 bp, Homo Sapiens
  primer_bind 1..18: upstream amplification primer 99-8663 for SEQ 2128,
actccattttatcacccc

SEQ ID NO: 6063 - DNA, 18 bp, Homo Sapiens
  primer_bind 1..18: upstream amplification primer 99-8665 for SEQ 2129,
ttcatttgttgggtggac

SEQ ID NO: 6064 - DNA, 18 bp, Homo Sapiens
  primer_bind 1..18: upstream amplification primer 99-8671 for SEQ 2130,
tgaaagttggattcgagg

SEQ ID NO: 6065 - DNA, 20 bp, Homo Sapiens
  primer_bind 1..20: upstream amplification primer 99-8695 for SEQ 2131,
gaatggctaaaaatggatgg

SEQ ID NO: 6066 - DNA, 19 bp, Homo Sapiens
  primer_bind 1..19: upstream amplification primer 99-870 for SEQ 2132,
cttagaaacagaaggtgtg

SEQ ID NO: 6067 - DNA, 20 bp, Homo Sapiens
  primer_bind 1..20: upstream amplification primer 99-8703 for SEQ 2133,
catgtgaatcaataagcacc

SEQ ID NO: 6068 - DNA, 18 bp, Homo Sapiens
  primer_bind 1..18: upstream amplification primer 99-8715 for SEQ 2134,
tctttatggcagtgtgag

SEQ ID NO: 6069 - DNA, 19 bp, Homo Sapiens
  primer_bind 1..19: upstream amplification primer 99-8725 for SEQ 2135,
cctctgagaatgatgagtg

SEQ ID NO: 6070 - DNA, 19 bp, Homo Sapiens
  primer_bind 1..19: upstream amplification primer 99-8732 for SEQ 2136,
ttgaaaagccctaacaaac

SEQ ID NO: 6071 - DNA, 19 bp, Homo Sapiens
  primer_bind 1..19: upstream amplification primer 99-8744 for SEQ 2137,
tgggaagattatatagagg

SEQ ID NO: 6072 - DNA, 19 bp, Homo Sapiens
  primer_bind 1..19: upstream amplification primer 99-8748 for SEQ 2138,
gttagaggttgaaaaaagg

SEQ ID NO: 6073 - DNA, 18 bp, Homo Sapiens
  primer_bind 1..18: upstream amplification primer 99-8755 for SEQ 2139,
ggtagtggtagaaagatg

SEQ ID NO: 6074 - DNA, 18 bp, Homo Sapiens
  primer_bind 1..18: upstream amplification primer 99-8761 for SEQ 2140,
tctggggtttgtgtttgg

SEQ ID NO: 6075 - DNA, 18 bp, Homo Sapiens
  primer_bind 1..18: upstream amplification primer 99-8775 for SEQ 2141,
ccatccttatctgactcc

SEQ ID NO: 6076 - DNA, 18 bp, Homo Sapiens
  primer_bind 1..18: upstream amplification primer 99-8778 for SEQ 2142,
taaaagcaatgagcagcc

SEQ ID NO: 6077 - DNA, 20 bp, Homo Sapiens
  primer_bind 1..20: upstream amplification primer 99-8780 for SEQ 2143,
acccatacccatagccagag

SEQ ID NO: 6078 - DNA, 18 bp, Homo Sapiens
  primer_bind 1..18: upstream amplification primer 99-8796 for SEQ 2144,
tattcatgtgtgacgggg

SEQ ID NO: 6079 - DNA, 19 bp, Homo Sapiens
  primer_bind 1..19: upstream amplification primer 99-8799 for SEQ 2145,
aggaaaatgggggagatgg

SEQ ID NO: 6080 - DNA, 20 bp, Homo Sapiens
  primer_bind 1..20: upstream amplification primer 99-88 for SEQ 2146,
gatagtatcggcaataaaac

SEQ ID NO: 6081 - DNA, 21 bp, Homo Sapiens
  primer_bind 1..21: upstream amplification primer 99-8800 for SEQ 2147,
aaatgctttttgtggggtgtg

SEQ ID NO: 6082 - DNA, 18 bp, Homo Sapiens
  primer_bind 1..18: upstream amplification primer 99-8802 for SEQ 2148,
gtcagtgtggtgtaatgg

SEQ ID NO: 6083 - DNA, 18 bp, Homo Sapiens
  primer_bind 1..18: upstream amplification primer 99-8804 for SEQ 2149,
atgacatttgggaagtgg

SEQ ID NO: 6084 - DNA, 19 bp, Homo Sapiens
  primer_bind 1..19: upstream amplification primer 99-8812 for SEQ 2150,
ccttccttaggtactattc

SEQ ID NO: 6085 - DNA, 18 bp, Homo Sapiens
  primer_bind 1..18: upstream amplification primer 99-8827 for SEQ 2151,
acttcccaaacctcttag

SEQ ID NO: 6086 - DNA, 18 bp, Homo Sapiens
  primer_bind 1..18: upstream amplification primer 99-8831 for SEQ 2152,
tgtttactgtttcggagg

SEQ ID NO: 6087 - DNA, 19 bp, Homo Sapiens
  primer_bind 1..19: upstream amplification primer 99-8835 for SEQ 2153,
gagttctatcaaattctgc

SEQ ID NO: 6088 - DNA, 19 bp, Homo Sapiens
  primer_bind 1..19: upstream amplification primer 99-8849 for SEQ 2154,
caacacagaagaacaagac

SEQ ID NO: 6089 - DNA, 20 bp, Homo Sapiens
  primer_bind 1..20: upstream amplification primer 99-8857 for SEQ 2155,
gaagaaagaaaatgtgctac

SEQ ID NO: 6090 - DNA, 20 bp, Homo Sapiens
  primer_bind 1..20: upstream amplification primer 99-8866 for SEQ 2156,
gttggtgttgttgaaaaagc

SEQ ID NO: 6091 - DNA, 21 bp, Homo Sapiens
  primer_bind 1..21: upstream amplification primer 99-8867 for SEQ 2157,
tcatctttcacattcacatcc

SEQ ID NO: 6092 - DNA, 19 bp, Homo Sapiens
  primer_bind 1..19: upstream amplification primer 99-8872 for SEQ 2158,
cttctctttggtgttctgg

SEQ ID NO: 6093 - DNA, 18 bp, Homo Sapiens
  primer_bind 1..18: upstream amplification primer 99-8885 for SEQ 2159,
ttgtttgtctgttggctg

SEQ ID NO: 6094 - DNA, 20 bp, Homo Sapiens
  primer_bind 1..20: upstream amplification primer 99-8887 for SEQ 2160,
tgttacttgtccttttcacc

SEQ ID NO: 6095 - DNA, 18 bp, Homo Sapiens
  primer_bind 1..18: upstream amplification primer 99-8894 for SEQ 2161,
agtcagaagaacacacag

SEQ ID NO: 6096 - DNA, 18 bp, Homo Sapiens
  primer_bind 1..18: upstream amplification primer 99-8895 for SEQ 2162,
gggtgttagcatctactc

SEQ ID NO: 6097 - DNA, 20 bp, Homo Sapiens
  primer_bind 1..20: upstream amplification primer 99-8901 for SEQ 2163,
gaatttgcagtatcattagg

SEQ ID NO: 6098 - DNA, 19 bp, Homo Sapiens
  primer_bind 1..19: upstream amplification primer 99-8905 for SEQ 2164,
agattagtcttgaactctg

SEQ ID NO: 6099 - DNA, 18 bp, Homo Sapiens
  primer_bind 1..18: upstream amplification primer 99-8910 for SEQ 2165,
cagaacctccttcttcag

SEQ ID NO: 6100 - DNA, 21 bp, Homo Sapiens
  primer_bind 1..21: upstream amplification primer 99-8923 for SEQ 2166,
caaataaccaaaaaggcaaag

SEQ ID NO: 6101 - DNA, 20 bp, Homo Sapiens
  primer_bind 1..20: upstream amplification primer 99-8924 for SEQ 2167,
gtgatatttttcagtctacc

SEQ ID NO: 6102 - DNA, 19 bp, Homo Sapiens
  primer_bind 1..19: upstream amplification primer 99-8960 for SEQ 2168,
ccacattttcaccttatac

SEQ ID NO: 6103 - DNA, 18 bp, Homo Sapiens
  primer_bind 1..18: upstream amplification primer 99-8963 for SEQ 2169,
gctgctaacttttgttcc

SEQ ID NO: 6104 - DNA, 19 bp, Homo Sapiens
  primer_bind 1..19: upstream amplification primer 99-8974 for SEQ 2170,
aagcccaaattaggattag

SEQ ID NO: 6105 - DNA, 18 bp, Homo Sapiens
  primer_bind 1..18: upstream amplification primer 99-8978 for SEQ 2171,
cttttccctatccttacc

SEQ ID NO: 6106 - DNA, 21 bp, Homo Sapiens
  primer_bind 1..21: upstream amplification primer 99-8992 for SEQ 2172,
gcactaattccaattagaatg

SEQ ID NO: 6107 - DNA, 19 bp, Homo Sapiens
  primer_bind 1..19: upstream amplification primer 99-9015 for SEQ 2173,
tgctttccaagacactccc

SEQ ID NO: 6108 - DNA, 18 bp, Homo Sapiens
  primer_bind 1..18: upstream amplification primer 99-9020 for SEQ 2174,
agagaagaatgctgcgtg

SEQ ID NO: 6109 - DNA, 18 bp, Homo Sapiens
  primer_bind 1..18: upstream amplification primer 99-9026 for SEQ 2175,
tatttccgactcctcacc

SEQ ID NO: 6110 - DNA, 19 bp, Homo Sapiens
  primer_bind 1..19: upstream amplification primer 99-9029 for SEQ 2176,
taatggctgtagatgtttg

SEQ ID NO: 6111 - DNA, 18 bp, Homo Sapiens
  primer_bind 1..18: upstream amplification primer 99-9047 for SEQ 2177,
ccacatactctcatctac

SEQ ID NO: 6112 - DNA, 18 bp, Homo Sapiens
  primer_bind 1..18: upstream amplification primer 99-9053 for SEQ 2178,
aatgggaggatgtaatgg

SEQ ID NO: 6113 - DNA, 19 bp, Homo Sapiens
  primer_bind 1..19: upstream amplification primer 99-9059 for SEQ 2179,
ccttagattgattgcctac

SEQ ID NO: 6114 - DNA, 18 bp, Homo Sapiens
  primer_bind 1..18: upstream amplification primer 99-9061 for SEQ 2180,
tctatcacctccaattcc

SEQ ID NO: 6115 - DNA, 20 bp, Homo Sapiens
  primer_bind 1..20: upstream amplification primer 99-9064 for SEQ 2181,
agacagggaacatctgccac

SEQ ID NO: 6116 - DNA, 18 bp, Homo Sapiens
  primer_bind 1..18: upstream amplification primer 99-9079 for SEQ 2182,
acaagtaagaggcagaag

SEQ ID NO: 6117 - DNA, 20 bp, Homo Sapiens
  primer_bind 1..20: upstream amplification primer 99-9084 for SEQ 2183,
agctcctgggaagggataac

SEQ ID NO: 6118 - DNA, 18 bp, Homo Sapiens
  primer_bind 1..18: upstream amplification primer 99-9092 for SEQ 2184,
agatgacatcactgtagg

SEQ ID NO: 6119 - DNA, 20 bp, Homo Sapiens
  primer_bind 1..20: upstream amplification primer 99-9097 for SEQ 2185,
aattcctgagtttgccttag

SEQ ID NO: 6120 - DNA, 18 bp, Homo Sapiens
  primer_bind 1..18: upstream amplification primer 99-9105 for SEQ 2186,
agagctagttcaaatccc

SEQ ID NO: 6121 - DNA, 18 bp, Homo Sapiens
  primer_bind 1..18: upstream amplification primer 99-9118 for SEQ 2187,
tgaggaacaagaagaagg

SEQ ID NO: 6122 - DNA, 20 bp, Homo Sapiens
  primer_bind 1..20: upstream amplification primer 99-9120 for SEQ 2188,
ggaaacggaaaggagaaaac

SEQ ID NO: 6123 - DNA, 20 bp, Homo Sapiens
  primer_bind 1..20: upstream amplification primer 99-9126 for SEQ 2189,
gcaggggggataaaaattgg

SEQ ID NO: 6124 - DNA, 18 bp, Homo Sapiens
  primer_bind 1..18: upstream amplification primer 99-913 for SEQ 2190,
attaccgagtcacttgcc

SEQ ID NO: 6125 - DNA, 18 bp, Homo Sapiens
  primer_bind 1..18: upstream amplification primer 99-9141 for SEQ 2191,
gagaggaggaatatttgg

SEQ ID NO: 6126 - DNA, 18 bp, Homo Sapiens
  primer_bind 1..18: upstream amplification primer 99-9152 for SEQ 2192,
acttacacacaccatctc

SEQ ID NO: 6127 - DNA, 20 bp, Homo Sapiens
  primer_bind 1..20: upstream amplification primer 99-9157 for SEQ 2193,
gagatgagaaaaaggatgac

SEQ ID NO: 6128 - DNA, 19 bp, Homo Sapiens
  primer_bind 1..19: upstream amplification primer 99-9175 for SEQ 2194,
cagtaggcagaataatagg

SEQ ID NO: 6129 - DNA, 19 bp, Homo Sapiens
  primer_bind 1..19: upstream amplification primer 99-9204 for SEQ 2195,
aatttaggagaagacagag

SEQ ID NO: 6130 - DNA, 18 bp, Homo Sapiens
  primer_bind 1..18: upstream amplification primer 99-921 for SEQ 2196,
ggctctgcttttatactg

SEQ ID NO: 6131 - DNA, 20 bp, Homo Sapiens
  primer_bind 1..20: upstream amplification primer 99-924 for SEQ 2197,
ctgaaatctaaacaaaaggg

SEQ ID NO: 6132 - DNA, 19 bp, Homo Sapiens
  primer_bind 1..19: upstream amplification primer 99-9240 for SEQ 2198,
gtccctattagtaaaggag

SEQ ID NO: 6133 - DNA, 19 bp, Homo Sapiens
  primer_bind 1..19: upstream amplification primer 99-9250 for SEQ 2199,
ctcatccttttctcacttc

SEQ ID NO: 6134 - DNA, 19 bp, Homo Sapiens
  primer_bind 1..19: upstream amplification primer 99-9254 for SEQ 2200,
ctcataaagttagataggg

SEQ ID NO: 6135 - DNA, 18 bp, Homo Sapiens
  primer_bind 1..18: upstream amplification primer 99-926 for SEQ 2201,
agagggtgaggaggaatg

SEQ ID NO: 6136 - DNA, 18 bp, Homo Sapiens
  primer_bind 1..18: upstream amplification primer 99-9263 for SEQ 2202,
gtgaaaggaatgagtggg

SEQ ID NO: 6137 - DNA, 18 bp, Homo Sapiens
  primer_bind 1..18: upstream amplification primer 99-9271 for SEQ 2203,
ccattccctttcaatccc

SEQ ID NO: 6138 - DNA, 18 bp, Homo Sapiens
  primer_bind 1..18: upstream amplification primer 99-9274 for SEQ 2204,
aatccagccatttgtcag

SEQ ID NO: 6139 - DNA, 20 bp, Homo Sapiens
  primer_bind 1..20: upstream amplification primer 99-9276 for SEQ 2205,
cttagccattgtgtaacatc

SEQ ID NO: 6140 - DNA, 18 bp, Homo Sapiens
  primer_bind 1..18: upstream amplification primer 99-9355 for SEQ 2206,
cagtacatcatgtctgcc

SEQ ID NO: 6141 - DNA, 19 bp, Homo Sapiens
  primer_bind 1..19: upstream amplification primer 99-9368 for SEQ 2207,
cccatttattgccacaaac

SEQ ID NO: 6142 - DNA, 19 bp, Homo Sapiens
  primer_bind 1..19: upstream amplification primer 99-937 for SEQ 2208,
gtgttaggaaaaatgatgg

SEQ ID NO: 6143 - DNA, 21 bp, Homo Sapiens
  primer_bind 1..21: upstream amplification primer 99-9372 for SEQ 2209,
ctatttccttttctcatcttc

SEQ ID NO: 6144 - DNA, 19 bp, Homo Sapiens
  primer_bind 1..19: upstream amplification primer 99-9381 for SEQ 2210,
ccagccaaacaattttcac

SEQ ID NO: 6145 - DNA, 19 bp, Homo Sapiens
  primer_bind 1..19: upstream amplification primer 99-9385 for SEQ 2211,
ggaaatagaggtttcaaag

SEQ ID NO: 6146 - DNA, 19 bp, Homo Sapiens
  primer_bind 1..19: upstream amplification primer 99-9389 for SEQ 2212,
tactaaacctcttctcttc

SEQ ID NO: 6147 - DNA, 19 bp, Homo Sapiens
  primer_bind 1..19: upstream amplification primer 99-9395 for SEQ 2213,
acctgctctctccaacatc

SEQ ID NO: 6148 - DNA, 18 bp, Homo Sapiens
  primer_bind 1..18: upstream amplification primer 99-9401 for SEQ 2214,
atatggtatgtggacctc

SEQ ID NO: 6149 - DNA, 19 bp, Homo Sapiens
  primer_bind 1..19: upstream amplification primer 99-9402 for SEQ 2215,
ttaatggcagcctctattg

SEQ ID NO: 6150 - DNA, 18 bp, Homo Sapiens
  primer_bind 1..18: upstream amplification primer 99-9404 for SEQ 2216,
tggctttgctcctctatc

SEQ ID NO: 6151 - DNA, 21 bp, Homo Sapiens
  primer_bind 1..21: upstream amplification primer 99-9405 for SEQ 2217,
gacatttttgaaccagtatag

SEQ ID NO: 6152 - DNA, 19 bp, Homo Sapiens
  primer_bind 1..19: upstream amplification primer 99-941 for SEQ 2218,
attgcccaactttattgtc

SEQ ID NO: 6153 - DNA, 19 bp, Homo Sapiens
  primer_bind 1..19: upstream amplification primer 99-9410 for SEQ 2219,
atttccatgtgaaggtaag

SEQ ID NO: 6154 - DNA, 18 bp, Homo Sapiens
  primer_bind 1..18: upstream amplification primer 99-9412 for SEQ 2220,
tacccacatacccaacac

SEQ ID NO: 6155 - DNA, 19 bp, Homo Sapiens
  primer_bind 1..19: upstream amplification primer 99-9417 for SEQ 2221,
aatggaaagttgcagaaag

SEQ ID NO: 6156 - DNA, 20 bp, Homo Sapiens
  primer_bind 1..20: upstream amplification primer 99-942 for SEQ 2222,
tcatttagccagccgactcc

SEQ ID NO: 6157 - DNA, 19 bp, Homo Sapiens
  primer_bind 1..19: upstream amplification primer 99-9420 for SEQ 2223,
gagagagaaatagaaaagg

SEQ ID NO: 6158 - DNA, 19 bp, Homo Sapiens
  primer_bind 1..19: upstream amplification primer 99-9421 for SEQ 2224,
tactttctatttttccccc

SEQ ID NO: 6159 - DNA, 20 bp, Homo Sapiens
  primer_bind 1..20: upstream amplification primer 99-9422 for SEQ 2225,
gaatatcttttgtgtgtgtg

SEQ ID NO: 6160 - DNA, 21 bp, Homo Sapiens
  primer_bind 1..21: upstream amplification primer 99-9423 for SEQ 2226,
gtgttttgtggttgccttatg

SEQ ID NO: 6161 - DNA, 18 bp, Homo Sapiens
  primer_bind 1..18: upstream amplification primer 99-9424 for SEQ 2227,
taaatcactcctgtcctc

SEQ ID NO: 6162 - DNA, 18 bp, Homo Sapiens
  primer_bind 1..18: upstream amplification primer 99-9427 for SEQ 2228,
gttatcttgctttccgcc

SEQ ID NO: 6163 - DNA, 21 bp, Homo Sapiens
  primer_bind 1..21: upstream amplification primer 99-9446 for SEQ 2229,
gaataccagaaatgatacaag

SEQ ID NO: 6164 - DNA, 18 bp, Homo Sapiens
  primer_bind 1..18: upstream amplification primer 99-9448 for SEQ 2230,
gtctgttgggattttagg

SEQ ID NO: 6165 - DNA, 18 bp, Homo Sapiens
  primer_bind 1..18: upstream amplification primer 99-9462 for SEQ 2231,
aggatatgggaaaagtgg

SEQ ID NO: 6166 - DNA, 19 bp, Homo Sapiens
  primer_bind 1..19: upstream amplification primer 99-9471 for SEQ 2232,
ccattgtaacttttcctcc

SEQ ID NO: 6167 - DNA, 21 bp, Homo Sapiens
  primer_bind 1..21: upstream amplification primer 99-949 for SEQ 2233,
gagaataaagaatgtgagttg

SEQ ID NO: 6168 - DNA, 18 bp, Homo Sapiens
  primer_bind 1..18: upstream amplification primer 99-9491 for SEQ 2234,
gtgtttttctcctccttc

SEQ ID NO: 6169 - DNA, 21 bp, Homo Sapiens
  primer_bind 1..21: upstream amplification primer 99-9493 for SEQ 2235,
gtagagaaaagtacaaaacag

SEQ ID NO: 6170 - DNA, 20 bp, Homo Sapiens
  primer_bind 1..20: upstream amplification primer 99-9499 for SEQ 2236,
tgggggaagggaagagtaag

SEQ ID NO: 6171 - DNA, 19 bp, Homo Sapiens
  primer_bind 1..19: upstream amplification primer 99-950 for SEQ 2237,
agaatgggttgaaatagag

SEQ ID NO: 6172 - DNA, 19 bp, Homo Sapiens
  primer_bind 1..19: upstream amplification primer 99-9513 for SEQ 2238,
tgcatctcagggaagtgac

SEQ ID NO: 6173 - DNA, 21 bp, Homo Sapiens
  primer_bind 1..21: upstream amplification primer 99-952 for SEQ 2239,
cacaaaatcataaatgaccag

SEQ ID NO: 6174 - DNA, 19 bp, Homo Sapiens
  primer_bind 1..19: upstream amplification primer 99-9527 for SEQ 2240,
gttgaatgtaggattttgg

SEQ ID NO: 6175 - DNA, 19 bp, Homo Sapiens
  primer_bind 1..19: upstream amplification primer 99-9531 for SEQ 2241,
ttgtaatttgttgaggagc

SEQ ID NO: 6176 - DNA, 18 bp, Homo Sapiens
  primer_bind 1..18: upstream amplification primer 99-9538 for SEQ 2242,
ctggaaactgattgtggg

SEQ ID NO: 6177 - DNA, 19 bp, Homo Sapiens
  primer_bind 1..19: upstream amplification primer 99-954 for SEQ 2243,
ttccaatttcacacatcac

SEQ ID NO: 6178 - DNA, 19 bp, Homo Sapiens
  primer_bind 1..19: upstream amplification primer 99-9542 for SEQ 2244,
ccaatcaacctctatcttc

SEQ ID NO: 6179 - DNA, 19 bp, Homo Sapiens
  primer_bind 1..19: upstream amplification primer 99-9545 for SEQ 2245,
atgatctcacatttctacc

SEQ ID NO: 6180 - DNA, 18 bp, Homo Sapiens
  primer_bind 1..18: upstream amplification primer 99-9554 for SEQ 2246,
tcaatacaccgacctcac

SEQ ID NO: 6181 - DNA, 19 bp, Homo Sapiens
  primer_bind 1..19: upstream amplification primer 99-9555 for SEQ 2247,
tgctcaatgcaaggcaatg

SEQ ID NO: 6182 - DNA, 18 bp, Homo Sapiens
  primer_bind 1..18: upstream amplification primer 99-9556 for SEQ 2248,
cctcaacccattagcaac

SEQ ID NO: 6183 - DNA, 19 bp, Homo Sapiens
  primer_bind 1..19: upstream amplification primer 99-9567 for SEQ 2249,
attgcggaggtgattcagg

SEQ ID NO: 6184 - DNA, 19 bp, Homo Sapiens
  primer_bind 1..19: upstream amplification primer 99-9572 for SEQ 2250,
cctattttagtcctccacc

SEQ ID NO: 6185 - DNA, 18 bp, Homo Sapiens
  primer_bind 1..18: upstream amplification primer 99-9577 for SEQ 2251,
tcatttcccaaatcctcc

SEQ ID NO: 6186 - DNA, 18 bp, Homo Sapiens
  primer_bind 1..18: upstream amplification primer 99-9579 for SEQ 2252,
gtttagaaggtggagagg

SEQ ID NO: 6187 - DNA, 18 bp, Homo Sapiens
  primer_bind 1..18: upstream amplification primer 99-958 for SEQ 2253,
gcatctggtctatgtaag

SEQ ID NO: 6188 - DNA, 21 bp, Homo Sapiens
  primer_bind 1..21: upstream amplification primer 99-9587 for SEQ 2254,
catttcaacatttcctatctg

SEQ ID NO: 6189 - DNA, 18 bp, Homo Sapiens
  primer_bind 1..18: upstream amplification primer 99-961 for SEQ 2255,
tattccaactccataccc

SEQ ID NO: 6190 - DNA, 19 bp, Homo Sapiens
  primer_bind 1..19: upstream amplification primer 99-963 for SEQ 2256,
atcataaagaggctacttc

SEQ ID NO: 6191 - DNA, 19 bp, Homo Sapiens
  primer_bind 1..19: upstream amplification primer 99-965 for SEQ 2257,
agcaaacattatagttccc

SEQ ID NO: 6192 - DNA, 18 bp, Homo Sapiens
  primer_bind 1..18: upstream amplification primer 99-967 for SEQ 2258,
gggagaggaaaaatagtg

SEQ ID NO: 6193 - DNA, 19 bp, Homo Sapiens
  primer_bind 1..19: upstream amplification primer 99-976 for SEQ 2259,
cactaaaatcctcatatcc

SEQ ID NO: 6194 - DNA, 19 bp, Homo Sapiens
  primer_bind 1..19: upstream amplification primer 99-979 for SEQ 2260,
gagatggatgaagagaagg

SEQ ID NO: 6195 - DNA, 21 bp, Homo Sapiens
  primer_bind 1..21: upstream amplification primer 99-10000 for SEQ 2261,
cacatttccactgataatacc

SEQ ID NO: 6196 - DNA, 21 bp, Homo Sapiens
  primer_bind 1..21: upstream amplification primer 99-10016 for SEQ 2262,
caacaacaactacattttcac

SEQ ID NO: 6197 - DNA, 20 bp, Homo Sapiens
  primer_bind 1..20: upstream amplification primer 99-10027 for SEQ 2263,
cattatttctcaaccgcatc

SEQ ID NO: 6198 - DNA, 18 bp, Homo Sapiens
  primer_bind 1..18: upstream amplification primer 99-10028 for SEQ 2264,
gtgcttatgtccttctcc

SEQ ID NO: 6199 - DNA, 20 bp, Homo Sapiens
  primer_bind 1..20: upstream amplification primer 99-10031 for SEQ 2265,
caaataaaaacagaaccccc

SEQ ID NO: 6200 - DNA, 20 bp, Homo Sapiens
  primer_bind 1..20: upstream amplification primer 99-10046 for SEQ 2266,
cccaaaacattattttctcc

SEQ ID NO: 6201 - DNA, 19 bp, Homo Sapiens
  primer_bind 1..19: upstream amplification primer 99-10064 for SEQ 2267,
actggtaatactaatgagg

SEQ ID NO: 6202 - DNA, 19 bp, Homo Sapiens
  primer_bind 1..19: upstream amplification primer 99-10066 for SEQ 2268,
atttgcttgttctgtctac

SEQ ID NO: 6203 - DNA, 21 bp, Homo Sapiens
  primer_bind 1..21: upstream amplification primer 99-10067 for SEQ 2269,
agcaatactattttgttggag

SEQ ID NO: 6204 - DNA, 21 bp, Homo Sapiens
  primer_bind 1..21: upstream amplification primer 99-10078 for SEQ 2270,
gcattagcaggcagcatcttc

SEQ ID NO: 6205 - DNA, 19 bp, Homo Sapiens
  primer_bind 1..19: upstream amplification primer 99-10104 for SEQ 2271,
acagccctaaagtaaaaac

SEQ ID NO: 6206 - DNA, 18 bp, Homo Sapiens
  primer_bind 1..18: upstream amplification primer 99-10106 for SEQ 2272,
agtgtatgactacgaagg

SEQ ID NO: 6207 - DNA, 20 bp, Homo Sapiens
  primer_bind 1..20: upstream amplification primer 99-10108 for SEQ 2273,
ggcaagtaacataataactg

SEQ ID NO: 6208 - DNA, 19 bp, Homo Sapiens
  primer_bind 1..19: upstream amplification primer 99-10118 for SEQ 2274,
gtaggattcttgcactatg

SEQ ID NO: 6209 - DNA, 18 bp, Homo Sapiens
  primer_bind 1..18: upstream amplification primer 99-10126 for SEQ 2275,
tcatagaccagttacccc

SEQ ID NO: 6210 - DNA, 19 bp, Homo Sapiens
  primer_bind 1..19: upstream amplification primer 99-10127 for SEQ 2276,
gacttcgtttcattcatgg

SEQ ID NO: 6211 - DNA, 19 bp, Homo Sapiens
  primer_bind 1..19: upstream amplification primer 99-10137 for SEQ 2277,
tttaccacatttaccagag

SEQ ID NO: 6212 - DNA, 21 bp, Homo Sapiens
  primer_bind 1..21: upstream amplification primer 99-10142 for SEQ 2278,
cattctttctgtccattatac

SEQ ID NO: 6213 - DNA, 19 bp, Homo Sapiens
  primer_bind 1..19: upstream amplification primer 99-10143 for SEQ 2279,
gtagcagtgaggttttatg

SEQ ID NO: 6214 - DNA, 19 bp, Homo Sapiens
  primer_bind 1..19: upstream amplification primer 99-10146 for SEQ 2280,
acttcaaaatgacttgacc

SEQ ID NO: 6215 - DNA, 18 bp, Homo Sapiens
  primer_bind 1..18: upstream amplification primer 99-10149 for SEQ 2281,
aagggcattttgctcctc

SEQ ID NO: 6216 - DNA, 20 bp, Homo Sapiens
  primer_bind 1..20: upstream amplification primer 99-10151 for SEQ 2282,
acagggaagttgaggtctgg

SEQ ID NO: 6217 - DNA, 20 bp, Homo Sapiens
  primer_bind 1..20: upstream amplification primer 99-10153 for SEQ 2283,
ggaagctcagaaagtgtatg

SEQ ID NO: 6218 - DNA, 20 bp, Homo Sapiens
  primer_bind 1..20: upstream amplification primer 99-10155 for SEQ 2284,
acctgggatgaacactggac

SEQ ID NO: 6219 - DNA, 19 bp, Homo Sapiens
  primer_bind 1..19: upstream amplification primer 99-10173 for SEQ 2285,
caatatctacttcaccttc

SEQ ID NO: 6220 - DNA, 19 bp, Homo Sapiens
  primer_bind 1..19: upstream amplification primer 99-10179 for SEQ 2286,
catactttaggtaacagtc

SEQ ID NO: 6221 - DNA, 20 bp, Homo Sapiens
  primer_bind 1..20: upstream amplification primer 99-1018 for SEQ 2287,
agaaaagaataatcgcaccc

SEQ ID NO: 6222 - DNA, 19 bp, Homo Sapiens
  primer_bind 1..19: upstream amplification primer 99-10183 for SEQ 2288,
gtgatgggatcattacaag

SEQ ID NO: 6223 - DNA, 18 bp, Homo Sapiens
  primer_bind 1..18: upstream amplification primer 99-10185 for SEQ 2289,
aacaaccagtagtctgcc

SEQ ID NO: 6224 - DNA, 20 bp, Homo Sapiens
  primer_bind 1..20: upstream amplification primer 99-10188 for SEQ 2290,
tagggcaggtgttggcaaag

SEQ ID NO: 6225 - DNA, 18 bp, Homo Sapiens
  primer_bind 1..18: upstream amplification primer 99-10201 for SEQ 2291,
agagtggaactccagttg

SEQ ID NO: 6226 - DNA, 20 bp, Homo Sapiens
  primer_bind 1..20: upstream amplification primer 99-10207 for SEQ 2292,
aaatcatcaccactttaacc

SEQ ID NO: 6227 - DNA, 20 bp, Homo Sapiens
  primer_bind 1..20: upstream amplification primer 99-10211 for SEQ 2293,
gctatgcaagtacatacatc

SEQ ID NO: 6228 - DNA, 19 bp, Homo Sapiens
  primer_bind 1..19: upstream amplification primer 99-10216 for SEQ 2294,
ttctttgcacaattactgg

SEQ ID NO: 6229 - DNA, 19 bp, Homo Sapiens
  primer_bind 1..19: upstream amplification primer 99-10220 for SEQ 2295,
atcatctactccctttcac

SEQ ID NO: 6230 - DNA, 18 bp, Homo Sapiens
  primer_bind 1..18: upstream amplification primer 99-10223 for SEQ 2296,
gctatccaaggcaatgtg

SEQ ID NO: 6231 - DNA, 19 bp, Homo Sapiens
  primer_bind 1..19: upstream amplification primer 99-10224 for SEQ 2297,
ctgccttcttaggtggttg

SEQ ID NO: 6232 - DNA, 20 bp, Homo Sapiens
  primer_bind 1..20: upstream amplification primer 99-10234 for SEQ 2298,
ggaggagacaattttttatc

SEQ ID NO: 6233 - DNA, 18 bp, Homo Sapiens
  primer_bind 1..18: upstream amplification primer 99-1024 for SEQ 2299,
atagcaactttccatccc

SEQ ID NO: 6234 - DNA, 21 bp, Homo Sapiens
  primer_bind 1..21: upstream amplification primer 99-10245 for SEQ 2300,
ctttaaggtggtaattttgac

SEQ ID NO: 6235 - DNA, 20 bp, Homo Sapiens
  primer_bind 1..20: upstream amplification primer 99-10256 for SEQ 2301,
gatcatgtttggtcgcaaag

SEQ ID NO: 6236 - DNA, 19 bp, Homo Sapiens
  primer_bind 1..19: upstream amplification primer 99-10264 for SEQ 2302,
ataagggaattgttgagag

SEQ ID NO: 6237 - DNA, 19 bp, Homo Sapiens
  primer_bind 1..19: upstream amplification primer 99-10266 for SEQ 2303,
ttgtttgtttgccaccccc

SEQ ID NO: 6238 - DNA, 19 bp, Homo Sapiens
  primer_bind 1..19: upstream amplification primer 99-10267 for SEQ 2304,
ctttttcctcgtcatcaac

SEQ ID NO: 6239 - DNA, 19 bp, Homo Sapiens
  primer_bind 1..19: upstream amplification primer 99-10303 for SEQ 2305,
tggctcttttctggctctg

SEQ ID NO: 6240 - DNA, 20 bp, Homo Sapiens
  primer_bind 1..20: upstream amplification primer 99-10304 for SEQ 2306,
tcctctctgatttcctcccc

SEQ ID NO: 6241 - DNA, 20 bp, Homo Sapiens
  primer_bind 1..20: upstream amplification primer 99-10312 for SEQ 2307,
ggaggactctattaggtagg

SEQ ID NO: 6242 - DNA, 21 bp, Homo Sapiens
  primer_bind 1..21: upstream amplification primer 99-10318 for SEQ 2308,
agaagccatgtagaaactggg

SEQ ID NO: 6243 - DNA, 20 bp, Homo Sapiens
  primer_bind 1..20: upstream amplification primer 99-10330 for SEQ 2309,
agatagtgggtaggggaagg

SEQ ID NO: 6244 - DNA, 19 bp, Homo Sapiens
  primer_bind 1..19: upstream amplification primer 99-10332 for SEQ 2310,
gtagtttgtttgggaagtg

SEQ ID NO: 6245 - DNA, 18 bp, Homo Sapiens
  primer_bind 1..18: upstream amplification primer 99-10345 for SEQ 2311,
gattcgggttagaaagac

SEQ ID NO: 6246 - DNA, 20 bp, Homo Sapiens
  primer_bind 1..20: upstream amplification primer 99-10353 for SEQ 2312,
tggaggaatcaagaaaaagc

SEQ ID NO: 6247 - DNA, 21 bp, Homo Sapiens
  primer_bind 1..21: upstream amplification primer 99-10364 for SEQ 2313,
aatgggaaatagacataagtg

SEQ ID NO: 6248 - DNA, 20 bp, Homo Sapiens
  primer_bind 1..20: upstream amplification primer 99-10369 for SEQ 2314,
tgggtcatctcaggctcatc

SEQ ID NO: 6249 - DNA, 19 bp, Homo Sapiens
  primer_bind 1..19: upstream amplification primer 99-10374 for SEQ 2315,
tttcagactcgttttgctc

SEQ ID NO: 6250 - DNA, 19 bp, Homo Sapiens
  primer_bind 1..19: upstream amplification primer 99-10381 for SEQ 2316,
aagtacaacgatccttacc

SEQ ID NO: 6251 - DNA, 19 bp, Homo Sapiens
  primer_bind 1..19: upstream amplification primer 99-10389 for SEQ 2317,
tcgctgctcaatttcatac

SEQ ID NO: 6252 - DNA, 20 bp, Homo Sapiens
  primer_bind 1..20: upstream amplification primer 99-10390 for SEQ 2318,
gggttagaaggagaattatg

SEQ ID NO: 6253 - DNA, 19 bp, Homo Sapiens
  primer_bind 1..19: upstream amplification primer 99-10414 for SEQ 2319,
acctgcctattagtcaggg

SEQ ID NO: 6254 - DNA, 20 bp, Homo Sapiens
  primer_bind 1..20: upstream amplification primer 99-10434 for SEQ 2320,
acagaatgaggtggtggtgg

SEQ ID NO: 6255 - DNA, 19 bp, Homo Sapiens
  primer_bind 1..19: upstream amplification primer 99-10436 for SEQ 2321,
agccgtcttagtgatgctg

SEQ ID NO: 6256 - DNA, 19 bp, Homo Sapiens
  primer_bind 1..19: upstream amplification primer 99-10438 for SEQ 2322,
tgcgagtcatttgagtggg

SEQ ID NO: 6257 - DNA, 21 bp, Homo Sapiens
  primer_bind 1..21: upstream amplification primer 99-10446 for SEQ 2323,
gccaaacactgacactaatac

SEQ ID NO: 6258 - DNA, 20 bp, Homo Sapiens
  primer_bind 1..20: upstream amplification primer 99-10451 for SEQ 2324,
gtgattgagtttcattcgtg

SEQ ID NO: 6259 - DNA, 20 bp, Homo Sapiens
  primer_bind 1..20: upstream amplification primer 99-10452 for SEQ 2325,
cttgggacagtgaagataag

SEQ ID NO: 6260 - DNA, 19 bp, Homo Sapiens
  primer_bind 1..19: upstream amplification primer 99-10457 for SEQ 2326,
acatgcaattcgtaagaag

SEQ ID NO: 6261 - DNA, 18 bp, Homo Sapiens
  primer_bind 1..18: upstream amplification primer 99-10470 for SEQ 2327,
attgatggggggaaactg

SEQ ID NO: 6262 - DNA, 20 bp, Homo Sapiens
  primer_bind 1..20: upstream amplification primer 99-10471 for SEQ 2328,
ccgatttattggttgttgag

SEQ ID NO: 6263 - DNA, 19 bp, Homo Sapiens
  primer_bind 1..19: upstream amplification primer 99-10473 for SEQ 2329,
gctctatttcttgtcacac

SEQ ID NO: 6264 - DNA, 20 bp, Homo Sapiens
  primer_bind 1..20: upstream amplification primer 99-10474 for SEQ 2330,
cagaatagcaccgtaatcag

SEQ ID NO: 6265 - DNA, 20 bp, Homo Sapiens
  primer_bind 1..20: upstream amplification primer 99-10481 for SEQ 2331,
cataagcaatgacaactatc

SEQ ID NO: 6266 - DNA, 21 bp, Homo Sapiens
  primer_bind 1..21: upstream amplification primer 99-10487 for SEQ 2332,
tcttctttctctctctggttc

SEQ ID NO: 6267 - DNA, 21 bp, Homo Sapiens
  primer_bind 1..21: upstream amplification primer 99-10488 for SEQ 2333,
actgttaaatgccaggtgttg

SEQ ID NO: 6268 - DNA, 21 bp, Homo Sapiens
  primer_bind 1..21: upstream amplification primer 99-10491 for SEQ 2334,
tagtgttggagcccagaaaac

SEQ ID NO: 6269 - DNA, 20 bp, Homo Sapiens
  primer_bind 1..20: upstream amplification primer 99-10499 for SEQ 2335,
ggagtagaatgagttcttgg

SEQ ID NO: 6270 - DNA, 19 bp, Homo Sapiens
  primer_bind 1..19: upstream amplification primer 99-10502 for SEQ 2336,
aagctctacattctgctgg

SEQ ID NO: 6271 - DNA, 21 bp, Homo Sapiens
  primer_bind 1..21: upstream amplification primer 99-10506 for SEQ 2337,
tgggaaattttcacaggacac

SEQ ID NO: 6272 - DNA, 21 bp, Homo Sapiens
  primer_bind 1..21: upstream amplification primer 99-10507 for SEQ 2338,
catttatcggagctgttatgg

SEQ ID NO: 6273 - DNA, 18 bp, Homo Sapiens
  primer_bind 1..18: upstream amplification primer 99-10509 for SEQ 2339,
gaagagataacggctgag

SEQ ID NO: 6274 - DNA, 20 bp, Homo Sapiens
  primer_bind 1..20: upstream amplification primer 99-1051 for SEQ 2340,
cttgtgatgtgaagtagatg

SEQ ID NO: 6275 - DNA, 20 bp, Homo Sapiens
  primer_bind 1..20: upstream amplification primer 99-10513 for SEQ 2341,
caaattagacagccaattag

SEQ ID NO: 6276 - DNA, 19 bp, Homo Sapiens
  primer_bind 1..19: upstream amplification primer 99-10514 for SEQ 2342,
ttgttttgggctttctttg

SEQ ID NO: 6277 - DNA, 19 bp, Homo Sapiens
  primer_bind 1..19: upstream amplification primer 99-10521 for SEQ 2343,
attatgcccttttgtgaac

SEQ ID NO: 6278 - DNA, 18 bp, Homo Sapiens
  primer_bind 1..18: upstream amplification primer 99-10522 for SEQ 2344,
ccagctctttttagggac

SEQ ID NO: 6279 - DNA, 20 bp, Homo Sapiens
  primer_bind 1..20: upstream amplification primer 99-10536 for SEQ 2345,
ccactctctctgatagacac

SEQ ID NO: 6280 - DNA, 20 bp, Homo Sapiens
  primer_bind 1..20: upstream amplification primer 99-10539 for SEQ 2346,
cagattagaatgtgagattg

SEQ ID NO: 6281 - DNA, 19 bp, Homo Sapiens
  primer_bind 1..19: upstream amplification primer 99-10542 for SEQ 2347,
ccagtgtgtagactatttg

SEQ ID NO: 6282 - DNA, 19 bp, Homo Sapiens
  primer_bind 1..19: upstream amplification primer 99-10543 for SEQ 2348,
aactgagtataagtgtctg

SEQ ID NO: 6283 - DNA, 21 bp, Homo Sapiens
  primer_bind 1..21: upstream amplification primer 99-1055 for SEQ 2349,
cacccagaaggcggaaataac

SEQ ID NO: 6284 - DNA, 21 bp, Homo Sapiens
  primer_bind 1..21: upstream amplification primer 99-10557 for SEQ 2350,
gtagaacttagtagcagtgac

SEQ ID NO: 6285 - DNA, 21 bp, Homo Sapiens
  primer_bind 1..21: upstream amplification primer 99-10567 for SEQ 2351,
ctttgacttctgccacgattg

SEQ ID NO: 6286 - DNA, 21 bp, Homo Sapiens
  primer_bind 1..21: upstream amplification primer 99-10570 for SEQ 2352,
gagtaaaatagccaagaaaag

SEQ ID NO: 6287 - DNA, 18 bp, Homo Sapiens
  primer_bind 1..18: upstream amplification primer 99-10573 for SEQ 2353,
tcacctgtaaccacattc

SEQ ID NO: 6288 - DNA, 18 bp, Homo Sapiens
  primer_bind 1..18: upstream amplification primer 99-10575 for SEQ 2354,
tatcgagactgatgtggg

SEQ ID NO: 6289 - DNA, 20 bp, Homo Sapiens
  primer_bind 1..20: upstream amplification primer 99-10576 for SEQ 2355,
cagccagggaagtaaataag

SEQ ID NO: 6290 - DNA, 20 bp, Homo Sapiens
  primer_bind 1..20: upstream amplification primer 99-10577 for SEQ 2356,
tccgagagccccaagattag

SEQ ID NO: 6291 - DNA, 19 bp, Homo Sapiens
  primer_bind 1..19: upstream amplification primer 99-10581 for SEQ 2357,
ctgaatcctaaggtctcac

SEQ ID NO: 6292 - DNA, 19 bp, Homo Sapiens
  primer_bind 1..19: upstream amplification primer 99-10589 for SEQ 2358,
agagacgaagccaagttcc

SEQ ID NO: 6293 - DNA, 21 bp, Homo Sapiens
  primer_bind 1..21: upstream amplification primer 99-10601 for SEQ 2359,
tagataccagaaccttcacag

SEQ ID NO: 6294 - DNA, 20 bp, Homo Sapiens
  primer_bind 1..20: upstream amplification primer 99-10606 for SEQ 2360,
cattttcctcttccaattcc

SEQ ID NO: 6295 - DNA, 19 bp, Homo Sapiens
  primer_bind 1..19: upstream amplification primer 99-10608 for SEQ 2361,
aaagcatattacaggatgg

SEQ ID NO: 6296 - DNA, 19 bp, Homo Sapiens
  primer_bind 1..19: upstream amplification primer 99-10613 for SEQ 2362,
gtgctatattcatcgtgtc

SEQ ID NO: 6297 - DNA, 20 bp, Homo Sapiens
  primer_bind 1..20: upstream amplification primer 99-10618 for SEQ 2363,
cctgaatgccttttttgttg

SEQ ID NO: 6298 - DNA, 19 bp, Homo Sapiens
  primer_bind 1..19: upstream amplification primer 99-10626 for SEQ 2364,
ctttatttttcaacgcccc

SEQ ID NO: 6299 - DNA, 19 bp, Homo Sapiens
  primer_bind 1..19: upstream amplification primer 99-10630 for SEQ 2365,
cagggtaaatttttggttc

SEQ ID NO: 6300 - DNA, 20 bp, Homo Sapiens
  primer_bind 1..20: upstream amplification primer 99-10632 for SEQ 2366,
gattcctataagtgaaactg

SEQ ID NO: 6301 - DNA, 20 bp, Homo Sapiens
  primer_bind 1..20: upstream amplification primer 99-10634 for SEQ 2367,
atgagattggggagcaaggg

SEQ ID NO: 6302 - DNA, 19 bp, Homo Sapiens
  primer_bind 1..19: upstream amplification primer 99-10643 for SEQ 2368,
ctggattgaagtggaaaag

SEQ ID NO: 6303 - DNA, 20 bp, Homo Sapiens
  primer_bind 1..20: upstream amplification primer 99-10659 for SEQ 2369,
gagcagtagtaaagagttcc

SEQ ID NO: 6304 - DNA, 20 bp, Homo Sapiens
  primer_bind 1..20: upstream amplification primer 99-10661 for SEQ 2370,
tttattccaatcctcctacc

SEQ ID NO: 6305 - DNA, 18 bp, Homo Sapiens
  primer_bind 1..18: upstream amplification primer 99-10662 for SEQ 2371,
gagttttacatgcgtggg

SEQ ID NO: 6306 - DNA, 20 bp, Homo Sapiens
  primer_bind 1..20: upstream amplification primer 99-10667 for SEQ 2372,
tctttctccctgtcactccc

SEQ ID NO: 6307 - DNA, 19 bp, Homo Sapiens
  primer_bind 1..19: upstream amplification primer 99-10675 for SEQ 2373,
aattatccatccaaaaccc

SEQ ID NO: 6308 - DNA, 18 bp, Homo Sapiens
  primer_bind 1..18: upstream amplification primer 99-1068 for SEQ 2374,
atacctttccctctcctc

SEQ ID NO: 6309 - DNA, 18 bp, Homo Sapiens
  primer_bind 1..18: upstream amplification primer 99-10683 for SEQ 2375,
taatgagaggggaatgtg

SEQ ID NO: 6310 - DNA, 18 bp, Homo Sapiens
  primer_bind 1..18: upstream amplification primer 99-10689 for SEQ 2376,
caaagttcagtatgtgcc

SEQ ID NO: 6311 - DNA, 19 bp, Homo Sapiens
  primer_bind 1..19: upstream amplification primer 99-10692 for SEQ 2377,
tggctatgtgaatcttttg

SEQ ID NO: 6312 - DNA, 19 bp, Homo Sapiens
  primer_bind 1..19: upstream amplification primer 99-10694 for SEQ 2378,
ctcctttgccaattttccc

SEQ ID NO: 6313 - DNA, 18 bp, Homo Sapiens
  primer_bind 1..18: upstream amplification primer 99-10695 for SEQ 2379,
ttgaagacgtggaaagcg

SEQ ID NO: 6314 - DNA, 19 bp, Homo Sapiens
  primer_bind 1..19: upstream amplification primer 99-1070 for SEQ 2380,
tctgccttagtttgggctc

SEQ ID NO: 6315 - DNA, 19 bp, Homo Sapiens
  primer_bind 1..19: upstream amplification primer 99-10702 for SEQ 2381,
caaccttgtttttagagac

SEQ ID NO: 6316 - DNA, 20 bp, Homo Sapiens
  primer_bind 1..20: upstream amplification primer 99-10706 for SEQ 2382,
ggataagtaaggttatgagg

SEQ ID NO: 6317 - DNA, 18 bp, Homo Sapiens
  primer_bind 1..18: upstream amplification primer 99-10708 for SEQ 2383,
tgcttcgttaaacacgtc

SEQ ID NO: 6318 - DNA, 18 bp, Homo Sapiens
  primer_bind 1..18: upstream amplification primer 99-10709 for SEQ 2384,
tctacaggatggtatgag

SEQ ID NO: 6319 - DNA, 18 bp, Homo Sapiens
  primer_bind 1..18: upstream amplification primer 99-10715 for SEQ 2385,
tactctatacaggatggg

SEQ ID NO: 6320 - DNA, 19 bp, Homo Sapiens
  primer_bind 1..19: upstream amplification primer 99-10719 for SEQ 2386,
gctattaatggaatgccag

SEQ ID NO: 6321 - DNA, 20 bp, Homo Sapiens
  primer_bind 1..20: upstream amplification primer 99-10720 for SEQ 2387,
caaaaatgtgacacccaaag

SEQ ID NO: 6322 - DNA, 19 bp, Homo Sapiens
  primer_bind 1..19: upstream amplification primer 99-10731 for SEQ 2388,
gcctccaagtagtattatc

SEQ ID NO: 6323 - DNA, 20 bp, Homo Sapiens
  primer_bind 1..20: upstream amplification primer 99-10735 for SEQ 2389,
ctaaacttaacttgcattcc

SEQ ID NO: 6324 - DNA, 18 bp, Homo Sapiens
  primer_bind 1..18: upstream amplification primer 99-1074 for SEQ 2390,
tgaataggtggagtagag

SEQ ID NO: 6325 - DNA, 20 bp, Homo Sapiens
  primer_bind 1..20: upstream amplification primer 99-10741 for SEQ 2391,
cccagtatatgtgtataaag

SEQ ID NO: 6326 - DNA, 21 bp, Homo Sapiens
  primer_bind 1..21: upstream amplification primer 99-10743 for SEQ 2392,
cttgttctcactatctttttc

SEQ ID NO: 6327 - DNA, 18 bp, Homo Sapiens
  primer_bind 1..18: upstream amplification primer 99-1075 for SEQ 2393,
tgaagaccgccaaactac

SEQ ID NO: 6328 - DNA, 21 bp, Homo Sapiens
  primer_bind 1..21: upstream amplification primer 99-10752 for SEQ 2394,
ggagttcagtattatacacag

SEQ ID NO: 6329 - DNA, 20 bp, Homo Sapiens
  primer_bind 1..20: upstream amplification primer 99-1076 for SEQ 2395,
cacaatcctcacatggaaac

SEQ ID NO: 6330 - DNA, 19 bp, Homo Sapiens
  primer_bind 1..19: upstream amplification primer 99-10769 for SEQ 2396,
agaccatagttagtgatag

SEQ ID NO: 6331 - DNA, 19 bp, Homo Sapiens
  primer_bind 1..19: upstream amplification primer 99-10771 for SEQ 2397,
tttgtcagtctcgtcgagg

SEQ ID NO: 6332 - DNA, 18 bp, Homo Sapiens
  primer_bind 1..18: upstream amplification primer 99-10775 for SEQ 2398,
gcggtcccatcataaaag

SEQ ID NO: 6333 - DNA, 20 bp, Homo Sapiens
  primer_bind 1..20: upstream amplification primer 99-10776 for SEQ 2399,
cctttcctatttctcatttc

SEQ ID NO: 6334 - DNA, 21 bp, Homo Sapiens
  primer_bind 1..21: upstream amplification primer 99-1079 for SEQ 2400,
gtggagagagaaagtaagttg

SEQ ID NO: 6335 - DNA, 18 bp, Homo Sapiens
  primer_bind 1..18: upstream amplification primer 99-1081 for SEQ 2401,
ttttcctctccttcaccc

SEQ ID NO: 6336 - DNA, 19 bp, Homo Sapiens
  primer_bind 1..19: upstream amplification primer 99-10816 for SEQ 2402,
ctctttatctgggtctctg

SEQ ID NO: 6337 - DNA, 21 bp, Homo Sapiens
  primer_bind 1..21: upstream amplification primer 99-1082 for SEQ 2403,
cagaaagtgatgactaaaggg

SEQ ID NO: 6338 - DNA, 18 bp, Homo Sapiens
  primer_bind 1..18: upstream amplification primer 99-10839 for SEQ 2404,
tttcggtacagatgcaac

SEQ ID NO: 6339 - DNA, 20 bp, Homo Sapiens
  primer_bind 1..20: upstream amplification primer 99-10842 for SEQ 2405,
gttctaccttgcttcttttg

SEQ ID NO: 6340 - DNA, 19 bp, Homo Sapiens
  primer_bind 1..19: upstream amplification primer 99-10843 for SEQ 2406,
gataaacctgttacatctg

SEQ ID NO: 6341 - DNA, 18 bp, Homo Sapiens
  primer_bind 1..18: upstream amplification primer 99-10856 for SEQ 2407,
tactgaccgaggagaaac

SEQ ID NO: 6342 - DNA, 20 bp, Homo Sapiens
  primer_bind 1..20: upstream amplification primer 99-10861 for SEQ 2408,
cagaaaagaagtgctacttg

SEQ ID NO: 6343 - DNA, 19 bp, Homo Sapiens
  primer_bind 1..19: upstream amplification primer 99-10862 for SEQ 2409,
caacaaataacagcctacc

SEQ ID NO: 6344 - DNA, 19 bp, Homo Sapiens
  primer_bind 1..19: upstream amplification primer 99-10864 for SEQ 2410,
actgggcacttgcttgaag

SEQ ID NO: 6345 - DNA, 20 bp, Homo Sapiens
  primer_bind 1..20: upstream amplification primer 99-10870 for SEQ 2411,
ggtgatttcttttcattagg

SEQ ID NO: 6346 - DNA, 21 bp, Homo Sapiens
  primer_bind 1..21: upstream amplification primer 99-10874 for SEQ 2412,
ggcttggttaagatgcaaatc

SEQ ID NO: 6347 - DNA, 20 bp, Homo Sapiens
  primer_bind 1..20: upstream amplification primer 99-10879 for SEQ 2413,
gataagaactgacttgaaac

SEQ ID NO: 6348 - DNA, 20 bp, Homo Sapiens
  primer_bind 1..20: upstream amplification primer 99-10887 for SEQ 2414,
gctgtggatatttgcagagg

SEQ ID NO: 6349 - DNA, 20 bp, Homo Sapiens
  primer_bind 1..20: upstream amplification primer 99-10890 for SEQ 2415,
aagaggtaggtaggggaagg

SEQ ID NO: 6350 - DNA, 20 bp, Homo Sapiens
  primer_bind 1..20: upstream amplification primer 99-10894 for SEQ 2416,
gtaggtaactgatagatatg

SEQ ID NO: 6351 - DNA, 19 bp, Homo Sapiens
  primer_bind 1..19: upstream amplification primer 99-10898 for SEQ 2417,
taagtgctgggctgtagtg

SEQ ID NO: 6352 - DNA, 19 bp, Homo Sapiens
  primer_bind 1..19: upstream amplification primer 99-10904 for SEQ 2418,
aatcgttgtgggtctggtg

SEQ ID NO: 6353 - DNA, 18 bp, Homo Sapiens
  primer_bind 1..18: upstream amplification primer 99-10905 for SEQ 2419,
agcagtacacgtaaatgg

SEQ ID NO: 6354 - DNA, 18 bp, Homo Sapiens
  primer_bind 1..18: upstream amplification primer 99-1091 for SEQ 2420,
ccttgttattgcctggag

SEQ ID NO: 6355 - DNA, 18 bp, Homo Sapiens
  primer_bind 1..18: upstream amplification primer 99-10927 for SEQ 2421,
gggagtgatgataggtgg

SEQ ID NO: 6356 - DNA, 19 bp, Homo Sapiens
  primer_bind 1..19: upstream amplification primer 99-10929 for SEQ 2422,
ctatgtcttttctgtctcc

SEQ ID NO: 6357 - DNA, 19 bp, Homo Sapiens
  primer_bind 1..19: upstream amplification primer 99-10930 for SEQ 2423,
atatttgtagaaggaaggg

SEQ ID NO: 6358 - DNA, 20 bp, Homo Sapiens
  primer_bind 1..20: upstream amplification primer 99-10937 for SEQ 2424,
ccatttacatactctatgtc

SEQ ID NO: 6359 - DNA, 19 bp, Homo Sapiens
  primer_bind 1..19: upstream amplification primer 99-10944 for SEQ 2425,
accatcggaaatggctgtg

SEQ ID NO: 6360 - DNA, 20 bp, Homo Sapiens
  primer_bind 1..20: upstream amplification primer 99-10951 for SEQ 2426,
catctgaaaaaagggtttgg

SEQ ID NO: 6361 - DNA, 20 bp, Homo Sapiens
  primer_bind 1..20: upstream amplification primer 99-10959 for SEQ 2427,
ccaattatacatctgagccc

SEQ ID NO: 6362 - DNA, 19 bp, Homo Sapiens
  primer_bind 1..19: upstream amplification primer 99-10964 for SEQ 2428,
aattaagctgcatacatcc

SEQ ID NO: 6363 - DNA, 18 bp, Homo Sapiens
  primer_bind 1..18: upstream amplification primer 99-10965 for SEQ 2429,
taaaatggctgcgttctc

SEQ ID NO: 6364 - DNA, 19 bp, Homo Sapiens
  primer_bind 1..19: upstream amplification primer 99-10966 for SEQ 2430,
tgaacctgacagaatatac

SEQ ID NO: 6365 - DNA, 18 bp, Homo Sapiens
  primer_bind 1..18: upstream amplification primer 99-10974 for SEQ 2431,
tggggagatgaggaatag

SEQ ID NO: 6366 - DNA, 20 bp, Homo Sapiens
  primer_bind 1..20: upstream amplification primer 99-10978 for SEQ 2432,
catcaataggcttttcaaac

SEQ ID NO: 6367 - DNA, 21 bp, Homo Sapiens
  primer_bind 1..21: upstream amplification primer 99-10979 for SEQ 2433,
ctgtttatcttagagagattg

SEQ ID NO: 6368 - DNA, 19 bp, Homo Sapiens
  primer_bind 1..19: upstream amplification primer 99-10988 for SEQ 2434,
ctgtaaaacagaggaaagg

SEQ ID NO: 6369 - DNA, 20 bp, Homo Sapiens
  primer_bind 1..20: upstream amplification primer 99-10992 for SEQ 2435,
gtcattaaatcatagtctcc

SEQ ID NO: 6370 - DNA, 19 bp, Homo Sapiens
  primer_bind 1..19: upstream amplification primer 99-11000 for SEQ 2436,
gaaaattaccagtcttgtc

SEQ ID NO: 6371 - DNA, 19 bp, Homo Sapiens
  primer_bind 1..19: upstream amplification primer 99-11001 for SEQ 2437,
attccagctacacattaac

SEQ ID NO: 6372 - DNA, 21 bp, Homo Sapiens
  primer_bind 1..21: upstream amplification primer 99-11003 for SEQ 2438,
gagtgggtatagtaaagatag

SEQ ID NO: 6373 - DNA, 19 bp, Homo Sapiens
  primer_bind 1..19: upstream amplification primer 99-11006 for SEQ 2439,
tacccttcatcctaatttc

SEQ ID NO: 6374 - DNA, 20 bp, Homo Sapiens
  primer_bind 1..20: upstream amplification primer 99-11007 for SEQ 2440,
catattttccctatactccc

SEQ ID NO: 6375 - DNA, 20 bp, Homo Sapiens
  primer_bind 1..20: upstream amplification primer 99-11014 for SEQ 2441,
ctcaatactatggaaccaag

SEQ ID NO: 6376 - DNA, 19 bp, Homo Sapiens
  primer_bind 1..19: upstream amplification primer 99-11034 for SEQ 2442,
gtttcactcagaacttcac

SEQ ID NO: 6377 - DNA, 20 bp, Homo Sapiens
  primer_bind 1..20: upstream amplification primer 99-11035 for SEQ 2443,
ggaaaagaatgagtaagttg

SEQ ID NO: 6378 - DNA, 19 bp, Homo Sapiens
  primer_bind 1..19: upstream amplification primer 99-11037 for SEQ 2444,
tcaatggctttcaactaac

SEQ ID NO: 6379 - DNA, 18 bp, Homo Sapiens
  primer_bind 1..18: upstream amplification primer 99-1105 for SEQ 2445,
gtggattgtgagataggg

SEQ ID NO: 6380 - DNA, 19 bp, Homo Sapiens
  primer_bind 1..19: upstream amplification primer 99-11051 for SEQ 2446,
aaatagcagatttggagac

SEQ ID NO: 6381 - DNA, 20 bp, Homo Sapiens
  primer_bind 1..20: upstream amplification primer 99-11063 for SEQ 2447,
ctgaactaaaactgctgttg

SEQ ID NO: 6382 - DNA, 18 bp, Homo Sapiens
  primer_bind 1..18: upstream amplification primer 99-11074 for SEQ 2448,
ttgaggttatggctgatg

SEQ ID NO: 6383 - DNA, 19 bp, Homo Sapiens
  primer_bind 1..19: upstream amplification primer 99-11075 for SEQ 2449,
agactacaacaaacacaac

SEQ ID NO: 6384 - DNA, 20 bp, Homo Sapiens
  primer_bind 1..20: upstream amplification primer 99-11089 for SEQ 2450,
ctgcccctttctaatataag

SEQ ID NO: 6385 - DNA, 20 bp, Homo Sapiens
  primer_bind 1..20: upstream amplification primer 99-11094 for SEQ 2451,
cttaatgaaaacgtgtttgg

SEQ ID NO: 6386 - DNA, 20 bp, Homo Sapiens
  primer_bind 1..20: upstream amplification primer 99-11099 for SEQ 2452,
ctcatgtttttgcctttttc

SEQ ID NO: 6387 - DNA, 19 bp, Homo Sapiens
  primer_bind 1..19: upstream amplification primer 99-11103 for SEQ 2453,
ggttttgtgaatggtgatg

SEQ ID NO: 6388 - DNA, 20 bp, Homo Sapiens
  primer_bind 1..20: upstream amplification primer 99-11106 for SEQ 2454,
cctcttactgtggaatactg

SEQ ID NO: 6389 - DNA, 18 bp, Homo Sapiens
  primer_bind 1..18: upstream amplification primer 99-11110 for SEQ 2455,
gttttgatgaagggttcc

SEQ ID NO: 6390 - DNA, 19 bp, Homo Sapiens
  primer_bind 1..19: upstream amplification primer 99-11115 for SEQ 2456,
attcgtctgattttgactg

SEQ ID NO: 6391 - DNA, 19 bp, Homo Sapiens
  primer_bind 1..19: upstream amplification primer 99-11119 for SEQ 2457,
gtgggaaaggatttacttg

SEQ ID NO: 6392 - DNA, 20 bp, Homo Sapiens
  primer_bind 1..20: upstream amplification primer 99-11128 for SEQ 2458,
gaggtggcaataaaagagag

SEQ ID NO: 6393 - DNA, 18 bp, Homo Sapiens
  primer_bind 1..18: upstream amplification primer 99-11136 for SEQ 2459,
agcatcgtgaatagccag

SEQ ID NO: 6394 - DNA, 19 bp, Homo Sapiens
  primer_bind 1..19: upstream amplification primer 99-11142 for SEQ 2460,
agcagagacattccaaggg

SEQ ID NO: 6395 - DNA, 20 bp, Homo Sapiens
  primer_bind 1..20: upstream amplification primer 99-11143 for SEQ 2461,
ggaagtttggaaatttgaag

SEQ ID NO: 6396 - DNA, 21 bp, Homo Sapiens
  primer_bind 1..21: upstream amplification primer 99-11144 for SEQ 2462,
caaaaagaaggcaatgaagac

SEQ ID NO: 6397 - DNA, 19 bp, Homo Sapiens
  primer_bind 1..19: upstream amplification primer 99-11148 for SEQ 2463,
tgaggtcctgaccaaatgc

SEQ ID NO: 6398 - DNA, 19 bp, Homo Sapiens
  primer_bind 1..19: upstream amplification primer 99-11158 for SEQ 2464,
agccacctatacagaggac

SEQ ID NO: 6399 - DNA, 18 bp, Homo Sapiens
  primer_bind 1..18: upstream amplification primer 99-11163 for SEQ 2465,
taatctggtgttgccttc

SEQ ID NO: 6400 - DNA, 19 bp, Homo Sapiens
  primer_bind 1..19: upstream amplification primer 99-11164 for SEQ 2466,
aatttatcactagcagacc

SEQ ID NO: 6401 - DNA, 21 bp, Homo Sapiens
  primer_bind 1..21: upstream amplification primer 99-11168 for SEQ 2467,
caagcaaagcattattattcc

SEQ ID NO: 6402 - DNA, 18 bp, Homo Sapiens
  primer_bind 1..18: upstream amplification primer 99-11175 for SEQ 2468,
ggactaacaaggaaggag

SEQ ID NO: 6403 - DNA, 20 bp, Homo Sapiens
  primer_bind 1..20: upstream amplification primer 99-11179 for SEQ 2469,
cttataaaacccactaaacc

SEQ ID NO: 6404 - DNA, 21 bp, Homo Sapiens
  primer_bind 1..21: upstream amplification primer 99-11180 for SEQ 2470,
gaaatacagtaagtgtgccag

SEQ ID NO: 6405 - DNA, 19 bp, Homo Sapiens
  primer_bind 1..19: upstream amplification primer 99-11183 for SEQ 2471,
gttagaaaaccattcgtag

SEQ ID NO: 6406 - DNA, 20 bp, Homo Sapiens
  primer_bind 1..20: upstream amplification primer 99-11191 for SEQ 2472,
ctaataaggcaggtactttg

SEQ ID NO: 6407 - DNA, 20 bp, Homo Sapiens
  primer_bind 1..20: upstream amplification primer 99-11210 for SEQ 2473,
gctggggactggattatgac

SEQ ID NO: 6408 - DNA, 19 bp, Homo Sapiens
  primer_bind 1..19: upstream amplification primer 99-11214 for SEQ 2474,
ctaaactccaatgccaacc

SEQ ID NO: 6409 - DNA, 19 bp, Homo Sapiens
  primer_bind 1..19: upstream amplification primer 99-11218 for SEQ 2475,
tatttgagagttggctctg

SEQ ID NO: 6410 - DNA, 20 bp, Homo Sapiens
  primer_bind 1..20: upstream amplification primer 99-11236 for SEQ 2476,
cactgttatccctgaaattg

SEQ ID NO: 6411 - DNA, 19 bp, Homo Sapiens
  primer_bind 1..19: upstream amplification primer 99-11247 for SEQ 2477,
ccttttgtcaagtttaccc

SEQ ID NO: 6412 - DNA, 21 bp, Homo Sapiens
  primer_bind 1..21: upstream amplification primer 99-11248 for SEQ 2478,
ctatttgcattttgatgacac

SEQ ID NO: 6413 - DNA, 18 bp, Homo Sapiens
  primer_bind 1..18: upstream amplification primer 99-11252 for SEQ 2479,
gctccacttgatcttgac

SEQ ID NO: 6414 - DNA, 20 bp, Homo Sapiens
  primer_bind 1..20: upstream amplification primer 99-11255 for SEQ 2480,
gaagggagttctttctattg

SEQ ID NO: 6415 - DNA, 21 bp, Homo Sapiens
  primer_bind 1..21: upstream amplification primer 99-11260 for SEQ 2481,
gagcatgacattattatggcg

SEQ ID NO: 6416 - DNA, 19 bp, Homo Sapiens
  primer_bind 1..19: upstream amplification primer 99-11261 for SEQ 2482,
gctatcatatctcaggaac

SEQ ID NO: 6417 - DNA, 20 bp, Homo Sapiens
  primer_bind 1..20: upstream amplification primer 99-11293 for SEQ 2483,
agcagctaccagctaccatc

SEQ ID NO: 6418 - DNA, 19 bp, Homo Sapiens
  primer_bind 1..19: upstream amplification primer 99-11313 for SEQ 2484,
cttatcaggtcgttatgag

SEQ ID NO: 6419 - DNA, 21 bp, Homo Sapiens
  primer_bind 1..21: upstream amplification primer 99-11320 for SEQ 2485,
gggtcttatgggtcttttttg

SEQ ID NO: 6420 - DNA, 19 bp, Homo Sapiens
  primer_bind 1..19: upstream amplification primer 99-11326 for SEQ 2486,
ataaagacctagtagtgtg

SEQ ID NO: 6421 - DNA, 18 bp, Homo Sapiens
  primer_bind 1..18: upstream amplification primer 99-11340 for SEQ 2487,
tgtgagtcagatgcgttc

SEQ ID NO: 6422 - DNA, 20 bp, Homo Sapiens
  primer_bind 1..20: upstream amplification primer 99-11346 for SEQ 2488,
gtattctctctatgtgtatc

SEQ ID NO: 6423 - DNA, 20 bp, Homo Sapiens
  primer_bind 1..20: upstream amplification primer 99-11350 for SEQ 2489,
cttaggtgtggataaatagg

SEQ ID NO: 6424 - DNA, 20 bp, Homo Sapiens
  primer_bind 1..20: upstream amplification primer 99-11356 for SEQ 2490,
tgcattggtggtgaggtagg

SEQ ID NO: 6425 - DNA, 20 bp, Homo Sapiens
  primer_bind 1..20: upstream amplification primer 99-11362 for SEQ 2491,
ccttaaataagctacaatcc

SEQ ID NO: 6426 - DNA, 20 bp, Homo Sapiens
  primer_bind 1..20: upstream amplification primer 99-11369 for SEQ 2492,
tataaagtccaaactgtccc

SEQ ID NO: 6427 - DNA, 20 bp, Homo Sapiens
  primer_bind 1..20: upstream amplification primer 99-11372 for SEQ 2493,
tgggctggctgagtttcaac

SEQ ID NO: 6428 - DNA, 20 bp, Homo Sapiens
  primer_bind 1..20: upstream amplification primer 99-11377 for SEQ 2494,
gatgaggaccctgtttattg

SEQ ID NO: 6429 - DNA, 19 bp, Homo Sapiens
  primer_bind 1..19: upstream amplification primer 99-11381 for SEQ 2495,
ggaagagaagtggatgaag

SEQ ID NO: 6430 - DNA, 19 bp, Homo Sapiens
  primer_bind 1..19: upstream amplification primer 99-11385 for SEQ 2496,
tggggatgctatttgtggg

SEQ ID NO: 6431 - DNA, 20 bp, Homo Sapiens
  primer_bind 1..20: upstream amplification primer 99-11413 for SEQ 2497,
tctgagcaagttgggttggc

SEQ ID NO: 6432 - DNA, 18 bp, Homo Sapiens
  primer_bind 1..18: upstream amplification primer 99-1143 for SEQ 2498,
aggaaagctggagttctg

SEQ ID NO: 6433 - DNA, 20 bp, Homo Sapiens
  primer_bind 1..20: upstream amplification primer 99-11430 for SEQ 2499,
gcaggtaattaaaaatggag

SEQ ID NO: 6434 - DNA, 19 bp, Homo Sapiens
  primer_bind 1..19: upstream amplification primer 99-11431 for SEQ 2500,
gattaactcctattcaccc

SEQ ID NO: 6435 - DNA, 20 bp, Homo Sapiens
  primer_bind 1..20: upstream amplification primer 99-11449 for SEQ 2501,
gagaaagtgactgagggctg

SEQ ID NO: 6436 - DNA, 19 bp, Homo Sapiens
  primer_bind 1..19: upstream amplification primer 99-11464 for SEQ 2502,
ttgagcaaataaggcacac

SEQ ID NO: 6437 - DNA, 20 bp, Homo Sapiens
  primer_bind 1..20: upstream amplification primer 99-11466 for SEQ 2503,
cacatttgacattttccatc

SEQ ID NO: 6438 - DNA, 20 bp, Homo Sapiens
  primer_bind 1..20: upstream amplification primer 99-11485 for SEQ 2504,
agcaagagagcctgttgacc

SEQ ID NO: 6439 - DNA, 21 bp, Homo Sapiens
  primer_bind 1..21: upstream amplification primer 99-11492 for SEQ 2505,
cctctgtcttaaatgttcatc

SEQ ID NO: 6440 - DNA, 19 bp, Homo Sapiens
  primer_bind 1..19: upstream amplification primer 99-11499 for SEQ 2506,
ctaaaaacaccctgtcttc

SEQ ID NO: 6441 - DNA, 19 bp, Homo Sapiens
  primer_bind 1..19: upstream amplification primer 99-11505 for SEQ 2507,
cacaagcaatatcaccaag

SEQ ID NO: 6442 - DNA, 19 bp, Homo Sapiens
  primer_bind 1..19: upstream amplification primer 99-11506 for SEQ 2508,
ccctgagcactatttatcc

SEQ ID NO: 6443 - DNA, 19 bp, Homo Sapiens
  primer_bind 1..19: upstream amplification primer 99-11520 for SEQ 2509,
cctaaccctaacttcctac

SEQ ID NO: 6444 - DNA, 19 bp, Homo Sapiens
  primer_bind 1..19: upstream amplification primer 99-11521 for SEQ 2510,
tggggcttgttctctaagg

SEQ ID NO: 6445 - DNA, 18 bp, Homo Sapiens
  primer_bind 1..18: upstream amplification primer 99-11522 for SEQ 2511,
tacaggctctagttcttc

SEQ ID NO: 6446 - DNA, 20 bp, Homo Sapiens
  primer_bind 1..20: upstream amplification primer 99-11528 for SEQ 2512,
gacaatagagttattgggag

SEQ ID NO: 6447 - DNA, 19 bp, Homo Sapiens
  primer_bind 1..19: upstream amplification primer 99-11530 for SEQ 2513,
gcttttcatccacattgtc

SEQ ID NO: 6448 - DNA, 20 bp, Homo Sapiens
  primer_bind 1..20: upstream amplification primer 99-11533 for SEQ 2514,
atattgtcccagtccccacc

SEQ ID NO: 6449 - DNA, 20 bp, Homo Sapiens
  primer_bind 1..20: upstream amplification primer 99-11535 for SEQ 2515,
tactcagcccttcctgcatc

SEQ ID NO: 6450 - DNA, 19 bp, Homo Sapiens
  primer_bind 1..19: upstream amplification primer 99-11543 for SEQ 2516,
tgggactgagaacataggg

SEQ ID NO: 6451 - DNA, 21 bp, Homo Sapiens
  primer_bind 1..21: upstream amplification primer 99-11545 for SEQ 2517,
gcttaaaggaagcaagctatc

SEQ ID NO: 6452 - DNA, 20 bp, Homo Sapiens
  primer_bind 1..20: upstream amplification primer 99-11555 for SEQ 2518,
gttgaggactagaggatttc

SEQ ID NO: 6453 - DNA, 18 bp, Homo Sapiens
  primer_bind 1..18: upstream amplification primer 99-11559 for SEQ 2519,
aaggctggtgttagagtc

SEQ ID NO: 6454 - DNA, 20 bp, Homo Sapiens
  primer_bind 1..20: upstream amplification primer 99-11563 for SEQ 2520,
aggtttggatgggaacgctg

SEQ ID NO: 6455 - DNA, 19 bp, Homo Sapiens
  primer_bind 1..19: upstream amplification primer 99-11565 for SEQ 2521,
gattttactcgcactttcc

SEQ ID NO: 6456 - DNA, 19 bp, Homo Sapiens
  primer_bind 1..19: upstream amplification primer 99-11566 for SEQ 2522,
tgcttaaaatctgctgctg

SEQ ID NO: 6457 - DNA, 19 bp, Homo Sapiens
  primer_bind 1..19: upstream amplification primer 99-11580 for SEQ 2523,
ctcgtcttaaacaaatccc

SEQ ID NO: 6458 - DNA, 19 bp, Homo Sapiens
  primer_bind 1..19: upstream amplification primer 99-11584 for SEQ 2524,
ccacacacaaaacacagac

SEQ ID NO: 6459 - DNA, 19 bp, Homo Sapiens
  primer_bind 1..19: upstream amplification primer 99-11587 for SEQ 2525,
cacacaaccatttcaaccc

SEQ ID NO: 6460 - DNA, 18 bp, Homo Sapiens
  primer_bind 1..18: upstream amplification primer 99-11592 for SEQ 2526,
caccaactactcaaatcc

SEQ ID NO: 6461 - DNA, 20 bp, Homo Sapiens
  primer_bind 1..20: upstream amplification primer 99-11600 for SEQ 2527,
tagcccccttactgcacatc

SEQ ID NO: 6462 - DNA, 19 bp, Homo Sapiens
  primer_bind 1..19: upstream amplification primer 99-11601 for SEQ 2528,
gcagagaacctcagaatac

SEQ ID NO: 6463 - DNA, 21 bp, Homo Sapiens
  primer_bind 1..21: upstream amplification primer 99-11602 for SEQ 2529,
ctgtatgctagttaaaagctg

SEQ ID NO: 6464 - DNA, 19 bp, Homo Sapiens
  primer_bind 1..19: upstream amplification primer 99-11604 for SEQ 2530,
taggtttccccgtcaactc

SEQ ID NO: 6465 - DNA, 20 bp, Homo Sapiens
  primer_bind 1..20: upstream amplification primer 99-11611 for SEQ 2531,
gacgacactgaacatatctc

SEQ ID NO: 6466 - DNA, 19 bp, Homo Sapiens
  primer_bind 1..19: upstream amplification primer 99-11613 for SEQ 2532,
cattagttgttcccttctc

SEQ ID NO: 6467 - DNA, 21 bp, Homo Sapiens
  primer_bind 1..21: upstream amplification primer 99-11620 for SEQ 2533,
tgaggattagactgaggagac

SEQ ID NO: 6468 - DNA, 21 bp, Homo Sapiens
  primer_bind 1..21: upstream amplification primer 99-11635 for SEQ 2534,
ggagaagtggtatgggaatag

SEQ ID NO: 6469 - DNA, 21 bp, Homo Sapiens
  primer_bind 1..21: upstream amplification primer 99-11643 for SEQ 2535,
catatttttttgtatcacccc

SEQ ID NO: 6470 - DNA, 20 bp, Homo Sapiens
  primer_bind 1..20: upstream amplification primer 99-11645 for SEQ 2536,
cctttcagtaaaggtgaatg

SEQ ID NO: 6471 - DNA, 21 bp, Homo Sapiens
  primer_bind 1..21: upstream amplification primer 99-11658 for SEQ 2537,
gacctgtggagttgccatttg

SEQ ID NO: 6472 - DNA, 21 bp, Homo Sapiens
  primer_bind 1..21: upstream amplification primer 99-11668 for SEQ 2538,
cacttttgggacaatgtatgg

SEQ ID NO: 6473 - DNA, 19 bp, Homo Sapiens
  primer_bind 1..19: upstream amplification primer 99-11669 for SEQ 2539,
gccttatgaactcaggaac

SEQ ID NO: 6474 - DNA, 19 bp, Homo Sapiens
  primer_bind 1..19: upstream amplification primer 99-11670 for SEQ 2540,
tagaggggaactagggatg

SEQ ID NO: 6475 - DNA, 20 bp, Homo Sapiens
  primer_bind 1..20: upstream amplification primer 99-11685 for SEQ 2541,
cagattacaggagaggaaac

SEQ ID NO: 6476 - DNA, 21 bp, Homo Sapiens
  primer_bind 1..21: upstream amplification primer 99-11697 for SEQ 2542,
caaatattaggtcagttgttc

SEQ ID NO: 6477 - DNA, 21 bp, Homo Sapiens
  primer_bind 1..21: upstream amplification primer 99-11700 for SEQ 2543,
gtattattgtatgtcacgaag

SEQ ID NO: 6478 - DNA, 20 bp, Homo Sapiens
  primer_bind 1..20: upstream amplification primer 99-11704 for SEQ 2544,
accaccaaatctgaccaccc

SEQ ID NO: 6479 - DNA, 19 bp, Homo Sapiens
  primer_bind 1..19: upstream amplification primer 99-11705 for SEQ 2545,
caatcagtccttttgaacc

SEQ ID NO: 6480 - DNA, 19 bp, Homo Sapiens
  primer_bind 1..19: upstream amplification primer 99-11723 for SEQ 2546,
aggcacccaaggcaattag

SEQ ID NO: 6481 - DNA, 19 bp, Homo Sapiens
  primer_bind 1..19: upstream amplification primer 99-11743 for SEQ 2547,
actgaatacaccagacccc

SEQ ID NO: 6482 - DNA, 19 bp, Homo Sapiens
  primer_bind 1..19: upstream amplification primer 99-11745 for SEQ 2548,
tttttcacacagcaggcgg

SEQ ID NO: 6483 - DNA, 20 bp, Homo Sapiens
  primer_bind 1..20: upstream amplification primer 99-11746 for SEQ 2549,
aggagtccctcagtttcttg

SEQ ID NO: 6484 - DNA, 18 bp, Homo Sapiens
  primer_bind 1..18: upstream amplification primer 99-11780 for SEQ 2550,
tgtgacatgcggtaactg

SEQ ID NO: 6485 - DNA, 19 bp, Homo Sapiens
  primer_bind 1..19: upstream amplification primer 99-11785 for SEQ 2551,
tcagcccttcctggttttc

SEQ ID NO: 6486 - DNA, 19 bp, Homo Sapiens
  primer_bind 1..19: upstream amplification primer 99-11786 for SEQ 2552,
actctcagataagccagcc

SEQ ID NO: 6487 - DNA, 20 bp, Homo Sapiens
  primer_bind 1..20: upstream amplification primer 99-11787 for SEQ 2553,
agcaggagagacaggtgaac

SEQ ID NO: 6488 - DNA, 18 bp, Homo Sapiens
  primer_bind 1..18: upstream amplification primer 99-11788 for SEQ 2554,
ggttcttgagttaagagg

SEQ ID NO: 6489 - DNA, 18 bp, Homo Sapiens
  primer_bind 1..18: upstream amplification primer 99-11789 for SEQ 2555,
gcctctactgtatggttg

SEQ ID NO: 6490 - DNA, 20 bp, Homo Sapiens
  primer_bind 1..20: upstream amplification primer 99-11797 for SEQ 2556,
tgtctccttccttccagtcc

SEQ ID NO: 6491 - DNA, 18 bp, Homo Sapiens
  primer_bind 1..18: upstream amplification primer 99-11810 for SEQ 2557,
gattcattcaagagcagg

SEQ ID NO: 6492 - DNA, 21 bp, Homo Sapiens
  primer_bind 1..21: upstream amplification primer 99-11811 for SEQ 2558,
gtgtgttttttttagagggtg

SEQ ID NO: 6493 - DNA, 18 bp, Homo Sapiens
  primer_bind 1..18: upstream amplification primer 99-1182 for SEQ 2559,
gcattaactgaacccatc

SEQ ID NO: 6494 - DNA, 20 bp, Homo Sapiens
  primer_bind 1..20: upstream amplification primer 99-11823 for SEQ 2560,
gaaccagtgacttttcaacc

SEQ ID NO: 6495 - DNA, 20 bp, Homo Sapiens
  primer_bind 1..20: upstream amplification primer 99-11824 for SEQ 2561,
gatattcacccaagtatttc

SEQ ID NO: 6496 - DNA, 19 bp, Homo Sapiens
  primer_bind 1..19: upstream amplification primer 99-1183 for SEQ 2562,
caccctatatttatgagac

SEQ ID NO: 6497 - DNA, 19 bp, Homo Sapiens
  primer_bind 1..19: upstream amplification primer 99-11830 for SEQ 2563,
gatcaatgagtgttcaagg

SEQ ID NO: 6498 - DNA, 20 bp, Homo Sapiens
  primer_bind 1..20: upstream amplification primer 99-11831 for SEQ 2564,
ttaaggaggctcaggctgtg

SEQ ID NO: 6499 - DNA, 19 bp, Homo Sapiens
  primer_bind 1..19: upstream amplification primer 99-11839 for SEQ 2565,
tgtgtgctgtgcgtaactg

SEQ ID NO: 6500 - DNA, 19 bp, Homo Sapiens
  primer_bind 1..19: upstream amplification primer 99-11842 for SEQ 2566,
ggatatgtcagagcaagag

SEQ ID NO: 6501 - DNA, 18 bp, Homo Sapiens
  primer_bind 1..18: upstream amplification primer 99-1185 for SEQ 2567,
gtgaactgtaaatctccc

SEQ ID NO: 6502 - DNA, 19 bp, Homo Sapiens
  primer_bind 1..19: upstream amplification primer 99-11851 for SEQ 2568,
ctgtatccatcatcctgtc

SEQ ID NO: 6503 - DNA, 20 bp, Homo Sapiens
  primer_bind 1..20: upstream amplification primer 99-11857 for SEQ 2569,
cacactaaatcagagaagag

SEQ ID NO: 6504 - DNA, 18 bp, Homo Sapiens
  primer_bind 1..18: upstream amplification primer 99-1186 for SEQ 2570,
cctttctcctctcttctc

SEQ ID NO: 6505 - DNA, 20 bp, Homo Sapiens
  primer_bind 1..20: upstream amplification primer 99-11861 for SEQ 2571,
tggctcaacctttccaggac

SEQ ID NO: 6506 - DNA, 18 bp, Homo Sapiens
  primer_bind 1..18: upstream amplification primer 99-11877 for SEQ 2572,
acatgggtgataaagggg

SEQ ID NO: 6507 - DNA, 19 bp, Homo Sapiens
  primer_bind 1..19: upstream amplification primer 99-11880 for SEQ 2573,
gagaaataagtcaagtccc

SEQ ID NO: 6508 - DNA, 20 bp, Homo Sapiens
  primer_bind 1..20: upstream amplification primer 99-11882 for SEQ 2574,
gtgaaacagcattgaaaagg

SEQ ID NO: 6509 - DNA, 19 bp, Homo Sapiens
  primer_bind 1..19: upstream amplification primer 99-11894 for SEQ 2575,
cagggttttcacaatcatc

SEQ ID NO: 6510 - DNA, 19 bp, Homo Sapiens
  primer_bind 1..19: upstream amplification primer 99-11917 for SEQ 2576,
gttccctaaatgttatctg

SEQ ID NO: 6511 - DNA, 20 bp, Homo Sapiens
  primer_bind 1..20: upstream amplification primer 99-11922 for SEQ 2577,
ctccttttgccctctgaatc

SEQ ID NO: 6512 - DNA, 21 bp, Homo Sapiens
  primer_bind 1..21: upstream amplification primer 99-11930 for SEQ 2578,
ccccttagtagaatatggatg

SEQ ID NO: 6513 - DNA, 20 bp, Homo Sapiens
  primer_bind 1..20: upstream amplification primer 99-11966 for SEQ 2579,
atctccacatcactccctgc

SEQ ID NO: 6514 - DNA, 20 bp, Homo Sapiens
  primer_bind 1..20: upstream amplification primer 99-11989 for SEQ 2580,
cccctcactactgttaaatc

SEQ ID NO: 6515 - DNA, 19 bp, Homo Sapiens
  primer_bind 1..19: upstream amplification primer 99-11993 for SEQ 2581,
acaccttttcctttctaac

SEQ ID NO: 6516 - DNA, 21 bp, Homo Sapiens
  primer_bind 1..21: upstream amplification primer 99-12000 for SEQ 2582,
gagttgataccaccagaaccc

SEQ ID NO: 6517 - DNA, 20 bp, Homo Sapiens
  primer_bind 1..20: upstream amplification primer 99-12005 for SEQ 2583,
cattggatatagtatatggg

SEQ ID NO: 6518 - DNA, 19 bp, Homo Sapiens
  primer_bind 1..19: upstream amplification primer 99-12017 for SEQ 2584,
ataggaaagagatgtgatg

SEQ ID NO: 6519 - DNA, 18 bp, Homo Sapiens
  primer_bind 1..18: upstream amplification primer 99-1202 for SEQ 2585,
ctggctcatgccgtcatc

SEQ ID NO: 6520 - DNA, 20 bp, Homo Sapiens
  primer_bind 1..20: upstream amplification primer 99-12028 for SEQ 2586,
cactgttcttttccttgttg

SEQ ID NO: 6521 - DNA, 18 bp, Homo Sapiens
  primer_bind 1..18: upstream amplification primer 99-1203 for SEQ 2587,
accctcttctactaagtg

SEQ ID NO: 6522 - DNA, 19 bp, Homo Sapiens
  primer_bind 1..19: upstream amplification primer 99-12038 for SEQ 2588,
tgggtagtagaagagattg

SEQ ID NO: 6523 - DNA, 20 bp, Homo Sapiens
  primer_bind 1..20: upstream amplification primer 99-12039 for SEQ 2589,
ggtgctattacaatactttc

SEQ ID NO: 6524 - DNA, 20 bp, Homo Sapiens
  primer_bind 1..20: upstream amplification primer 99-12048 for SEQ 2590,
ccatttctcatccatcattg

SEQ ID NO: 6525 - DNA, 18 bp, Homo Sapiens
  primer_bind 1..18: upstream amplification primer 99-12049 for SEQ 2591,
aagatcccattgaccctg

SEQ ID NO: 6526 - DNA, 19 bp, Homo Sapiens
  primer_bind 1..19: upstream amplification primer 99-12050 for SEQ 2592,
gactcaaaagttcaactcc

SEQ ID NO: 6527 - DNA, 21 bp, Homo Sapiens
  primer_bind 1..21: upstream amplification primer 99-12061 for SEQ 2593,
aagagtgaaaaagggaggtag

SEQ ID NO: 6528 - DNA, 19 bp, Homo Sapiens
  primer_bind 1..19: upstream amplification primer 99-12062 for SEQ 2594,
gtggcaagtgctatttagg

SEQ ID NO: 6529 - DNA, 21 bp, Homo Sapiens
  primer_bind 1..21: upstream amplification primer 99-12068 for SEQ 2595,
ctccttctcctttctttttcc

SEQ ID NO: 6530 - DNA, 19 bp, Homo Sapiens
  primer_bind 1..19: upstream amplification primer 99-12087 for SEQ 2596,
ctctcatggcaacttttag

SEQ ID NO: 6531 - DNA, 18 bp, Homo Sapiens
  primer_bind 1..18: upstream amplification primer 99-1211 for SEQ 2597,
tagggaacaagtggttgg

SEQ ID NO: 6532 - DNA, 21 bp, Homo Sapiens
  primer_bind 1..21: upstream amplification primer 99-12130 for SEQ 2598,
ctcttctcatcctccttattc

SEQ ID NO: 6533 - DNA, 20 bp, Homo Sapiens
  primer_bind 1..20: upstream amplification primer 99-12133 for SEQ 2599,
gcataatacctgcatagcac

SEQ ID NO: 6534 - DNA, 20 bp, Homo Sapiens
  primer_bind 1..20: upstream amplification primer 99-12135 for SEQ 2600,
gggttacttttaatttctgg

SEQ ID NO: 6535 - DNA, 19 bp, Homo Sapiens
  primer_bind 1..19: upstream amplification primer 99-12152 for SEQ 2601,
ttgccagtaatggacacgg

SEQ ID NO: 6536 - DNA, 20 bp, Homo Sapiens
  primer_bind 1..20: upstream amplification primer 99-12158 for SEQ 2602,
acgaatggtcccaccagaag

SEQ ID NO: 6537 - DNA, 18 bp, Homo Sapiens
  primer_bind 1..18: upstream amplification primer 99-12168 for SEQ 2603,
acatctcgtttacttgcc

SEQ ID NO: 6538 - DNA, 20 bp, Homo Sapiens
  primer_bind 1..20: upstream amplification primer 99-12171 for SEQ 2604,
gagtcaaccctggaggtaag

SEQ ID NO: 6539 - DNA, 20 bp, Homo Sapiens
  primer_bind 1..20: upstream amplification primer 99-12178 for SEQ 2605,
caagcccagcatctattttc

SEQ ID NO: 6540 - DNA, 19 bp, Homo Sapiens
  primer_bind 1..19: upstream amplification primer 99-12181 for SEQ 2606,
ccatatagtagtggcaaac

SEQ ID NO: 6541 - DNA, 19 bp, Homo Sapiens
  primer_bind 1..19: upstream amplification primer 99-12186 for SEQ 2607,
caaacaccaatcaaccttc

SEQ ID NO: 6542 - DNA, 20 bp, Homo Sapiens
  primer_bind 1..20: upstream amplification primer 99-12198 for SEQ 2608,
atgtggagtgtggtgctagg

SEQ ID NO: 6543 - DNA, 21 bp, Homo Sapiens
  primer_bind 1..21: upstream amplification primer 99-12199 for SEQ 2609,
gtttgtttagaggaaaaggtc

SEQ ID NO: 6544 - DNA, 19 bp, Homo Sapiens
  primer_bind 1..19: upstream amplification primer 99-12203 for SEQ 2610,
tgagaactatccatctaac

SEQ ID NO: 6545 - DNA, 18 bp, Homo Sapiens
  primer_bind 1..18: upstream amplification primer 99-12224 for SEQ 2611,
agagttgggcaacaatcg

SEQ ID NO: 6546 - DNA, 19 bp, Homo Sapiens
  primer_bind 1..19: upstream amplification primer 99-12228 for SEQ 2612,
ttacataaccaccataacc

SEQ ID NO: 6547 - DNA, 19 bp, Homo Sapiens
  primer_bind 1..19: upstream amplification primer 99-12241 for SEQ 2613,
tcatccagtgctccacaac

SEQ ID NO: 6548 - DNA, 21 bp, Homo Sapiens
  primer_bind 1..21: upstream amplification primer 99-12253 for SEQ 2614,
cttatttcataggtgtaacgc

SEQ ID NO: 6549 - DNA, 18 bp, Homo Sapiens
  primer_bind 1..18: upstream amplification primer 99-12265 for SEQ 2615,
gcaaatggttccacaatc

SEQ ID NO: 6550 - DNA, 18 bp, Homo Sapiens
  primer_bind 1..18: upstream amplification primer 99-12267 for SEQ 2616,
cttagcaggattatctgg

SEQ ID NO: 6551 - DNA, 20 bp, Homo Sapiens
  primer_bind 1..20: upstream amplification primer 99-12268 for SEQ 2617,
ctcatactcatccaaaactc

SEQ ID NO: 6552 - DNA, 21 bp, Homo Sapiens
  primer_bind 1..21: upstream amplification primer 99-12270 for SEQ 2618,
gtaggtgctggaattgtgctg

SEQ ID NO: 6553 - DNA, 20 bp, Homo Sapiens
  primer_bind 1..20: upstream amplification primer 99-12271 for SEQ 2619,
aaaatatccaaggggcaaag

SEQ ID NO: 6554 - DNA, 18 bp, Homo Sapiens
  primer_bind 1..18: upstream amplification primer 99-12275 for SEQ 2620,
atctcatccctactatcc

SEQ ID NO: 6555 - DNA, 19 bp, Homo Sapiens
  primer_bind 1..19: upstream amplification primer 99-12299 for SEQ 2621,
cctttttgattccagtatg

SEQ ID NO: 6556 - DNA, 19 bp, Homo Sapiens
  primer_bind 1..19: upstream amplification primer 99-12303 for SEQ 2622,
tgatccctctctgaatgcc

SEQ ID NO: 6557 - DNA, 20 bp, Homo Sapiens
  primer_bind 1..20: upstream amplification primer 99-12335 for SEQ 2623,
cagtttcataaaaggtaagg

SEQ ID NO: 6558 - DNA, 19 bp, Homo Sapiens
  primer_bind 1..19: upstream amplification primer 99-12338 for SEQ 2624,
tctgctcttctggaagctg

SEQ ID NO: 6559 - DNA, 20 bp, Homo Sapiens
  primer_bind 1..20: upstream amplification primer 99-12344 for SEQ 2625,
gcttgacttcttaacctatg

SEQ ID NO: 6560 - DNA, 20 bp, Homo Sapiens
  primer_bind 1..20: upstream amplification primer 99-12347 for SEQ 2626,
cagtttaacagatgattcag

SEQ ID NO: 6561 - DNA, 21 bp, Homo Sapiens
  primer_bind 1..21: upstream amplification primer 99-12348 for SEQ 2627,
ctactttttacttcacttgtc

SEQ ID NO: 6562 - DNA, 20 bp, Homo Sapiens
  primer_bind 1..20: upstream amplification primer 99-12352 for SEQ 2628,
ctgtcatgtgtaaactattc

SEQ ID NO: 6563 - DNA, 20 bp, Homo Sapiens
  primer_bind 1..20: upstream amplification primer 99-12356 for SEQ 2629,
tctgatttgggatggggctg

SEQ ID NO: 6564 - DNA, 21 bp, Homo Sapiens
  primer_bind 1..21: upstream amplification primer 99-12361 for SEQ 2630,
caaggaacacaagagtttgag

SEQ ID NO: 6565 - DNA, 20 bp, Homo Sapiens
  primer_bind 1..20: upstream amplification primer 99-12368 for SEQ 2631,
gaacagaaggtattgaacag

SEQ ID NO: 6566 - DNA, 19 bp, Homo Sapiens
  primer_bind 1..19: upstream amplification primer 99-12370 for SEQ 2632,
attacgcaagcactacgcc

SEQ ID NO: 6567 - DNA, 19 bp, Homo Sapiens
  primer_bind 1..19: upstream amplification primer 99-12384 for SEQ 2633,
atgaagtggagaagaggag

SEQ ID NO: 6568 - DNA, 21 bp, Homo Sapiens
  primer_bind 1..21: upstream amplification primer 99-12388 for SEQ 2634,
agaattttccagcagacttcc

SEQ ID NO: 6569 - DNA, 21 bp, Homo Sapiens
  primer_bind 1..21: upstream amplification primer 99-12393 for SEQ 2635,
ggttccacaattctatcacag

SEQ ID NO: 6570 - DNA, 19 bp, Homo Sapiens
  primer_bind 1..19: upstream amplification primer 99-12399 for SEQ 2636,
gcttgtgtaataatgagtc

SEQ ID NO: 6571 - DNA, 21 bp, Homo Sapiens
  primer_bind 1..21: upstream amplification primer 99-12412 for SEQ 2637,
cacaatcttttgagaaaaagg

SEQ ID NO: 6572 - DNA, 19 bp, Homo Sapiens
  primer_bind 1..19: upstream amplification primer 99-12415 for SEQ 2638,
cacttactcctgtcatttc

SEQ ID NO: 6573 - DNA, 20 bp, Homo Sapiens
  primer_bind 1..20: upstream amplification primer 99-12444 for SEQ 2639,
ccaaacattaatcaagtgcc

SEQ ID NO: 6574 - DNA, 21 bp, Homo Sapiens
  primer_bind 1..21: upstream amplification primer 99-12465 for SEQ 2640,
ccctaaagtccaaataataac

SEQ ID NO: 6575 - DNA, 19 bp, Homo Sapiens
  primer_bind 1..19: upstream amplification primer 99-12468 for SEQ 2641,
aatcttgccctcctgagtc

SEQ ID NO: 6576 - DNA, 20 bp, Homo Sapiens
  primer_bind 1..20: upstream amplification primer 99-12470 for SEQ 2642,
ggaatcctcattgggaacac

SEQ ID NO: 6577 - DNA, 20 bp, Homo Sapiens
  primer_bind 1..20: upstream amplification primer 99-12522 for SEQ 2643,
tcggctctaagctggtgttg

SEQ ID NO: 6578 - DNA, 20 bp, Homo Sapiens
  primer_bind 1..20: upstream amplification primer 99-12561 for SEQ 2644,
tgattggggagcagaagagc

SEQ ID NO: 6579 - DNA, 21 bp, Homo Sapiens
  primer_bind 1..21: upstream amplification primer 99-12570 for SEQ 2645,
ccctactattctcttcaggtc

SEQ ID NO: 6580 - DNA, 18 bp, Homo Sapiens
  primer_bind 1..18: upstream amplification primer 99-12595 for SEQ 2646,
ttaaggacaaggtacagg

SEQ ID NO: 6581 - DNA, 21 bp, Homo Sapiens
  primer_bind 1..21: upstream amplification primer 99-12596 for SEQ 2647,
tctaccaaaggataacagcag

SEQ ID NO: 6582 - DNA, 20 bp, Homo Sapiens
  primer_bind 1..20: upstream amplification primer 99-12598 for SEQ 2648,
gtgaggtagatgtgataatg

SEQ ID NO: 6583 - DNA, 20 bp, Homo Sapiens
  primer_bind 1..20: upstream amplification primer 99-12602 for SEQ 2649,
cctttatccacacagaggag

SEQ ID NO: 6584 - DNA, 20 bp, Homo Sapiens
  primer_bind 1..20: upstream amplification primer 99-12605 for SEQ 2650,
gcatgagaaattgagtatgg

SEQ ID NO: 6585 - DNA, 20 bp, Homo Sapiens
  primer_bind 1..20: upstream amplification primer 99-12607 for SEQ 2651,
tatagcaaggagcagccgtg

SEQ ID NO: 6586 - DNA, 20 bp, Homo Sapiens
  primer_bind 1..20: upstream amplification primer 99-12664 for SEQ 2652,
gggctgaaatctaaaatagg

SEQ ID NO: 6587 - DNA, 21 bp, Homo Sapiens
  primer_bind 1..21: upstream amplification primer 99-12696 for SEQ 2653,
gaaaaagaaaacattcctacc

SEQ ID NO: 6588 - DNA, 20 bp, Homo Sapiens
  primer_bind 1..20: upstream amplification primer 99-12960 for SEQ 2654,
gacctacaaatacatagaac

SEQ ID NO: 6589 - DNA, 20 bp, Homo Sapiens
  primer_bind 1..20: upstream amplification primer 99-12965 for SEQ 2655,
gaagaaaaaaatgtgagtgg

SEQ ID NO: 6590 - DNA, 21 bp, Homo Sapiens
  primer_bind 1..21: upstream amplification primer 99-12969 for SEQ 2656,
tctaactctactgaatggggg

SEQ ID NO: 6591 - DNA, 20 bp, Homo Sapiens
  primer_bind 1..20: upstream amplification primer 99-12970 for SEQ 2657,
ctagttttaggaaagtgttc

SEQ ID NO: 6592 - DNA, 19 bp, Homo Sapiens
  primer_bind 1..19: upstream amplification primer 99-12973 for SEQ 2658,
cgaataaatcctcaggaac

SEQ ID NO: 6593 - DNA, 19 bp, Homo Sapiens
  primer_bind 1..19: upstream amplification primer 99-13074 for SEQ 2659,
acttagtaacacttctctc

SEQ ID NO: 6594 - DNA, 18 bp, Homo Sapiens
  primer_bind 1..18: upstream amplification primer 99-13077 for SEQ 2660,
atgagtctactgtcagtg

SEQ ID NO: 6595 - DNA, 18 bp, Homo Sapiens
  primer_bind 1..18: upstream amplification primer 99-1311 for SEQ 2661,
ttagagtcaggattcagg

SEQ ID NO: 6596 - DNA, 21 bp, Homo Sapiens
  primer_bind 1..21: upstream amplification primer 99-13113 for SEQ 2662,
actttgaaatctgtagatgtg

SEQ ID NO: 6597 - DNA, 18 bp, Homo Sapiens
  primer_bind 1..18: upstream amplification primer 99-13205 for SEQ 2663,
cagaggaggacataaaag

SEQ ID NO: 6598 - DNA, 19 bp, Homo Sapiens
  primer_bind 1..19: upstream amplification primer 99-1326 for SEQ 2664,
ctaacaaggataagatggg

SEQ ID NO: 6599 - DNA, 20 bp, Homo Sapiens
  primer_bind 1..20: upstream amplification primer 99-1333 for SEQ 2665,
cagtaatgttgaatttacgg

SEQ ID NO: 6600 - DNA, 20 bp, Homo Sapiens
  primer_bind 1..20: upstream amplification primer 99-1335 for SEQ 2666,
gagaaaaatatgagagcctg

SEQ ID NO: 6601 - DNA, 21 bp, Homo Sapiens
  primer_bind 1..21: upstream amplification primer 99-13350 for SEQ 2667,
catatacatggcaaaatagac

SEQ ID NO: 6602 - DNA, 18 bp, Homo Sapiens
  primer_bind 1..18: upstream amplification primer 99-13376 for SEQ 2668,
acatcttagaagtgaggg

SEQ ID NO: 6603 - DNA, 19 bp, Homo Sapiens
  primer_bind 1..19: upstream amplification primer 99-13473 for SEQ 2669,
tcttccaagtctgtcaccc

SEQ ID NO: 6604 - DNA, 21 bp, Homo Sapiens
  primer_bind 1..21: upstream amplification primer 99-13530 for SEQ 2670,
cttgccactctcagttgtatc

SEQ ID NO: 6605 - DNA, 19 bp, Homo Sapiens
  primer_bind 1..19: upstream amplification primer 99-13563 for SEQ 2671,
atatcacttcaaaactccc

SEQ ID NO: 6606 - DNA, 20 bp, Homo Sapiens
  primer_bind 1..20: upstream amplification primer 99-13579 for SEQ 2672,
gggtctgattgaaattatgg

SEQ ID NO: 6607 - DNA, 19 bp, Homo Sapiens
  primer_bind 1..19: upstream amplification primer 99-13609 for SEQ 2673,
agctggttccgctgtaaac

SEQ ID NO: 6608 - DNA, 18 bp, Homo Sapiens
  primer_bind 1..18: upstream amplification primer 99-13621 for SEQ 2674,
ggtttttatgggaagagg

SEQ ID NO: 6609 - DNA, 20 bp, Homo Sapiens
  primer_bind 1..20: upstream amplification primer 99-1370 for SEQ 2675,
gcattggttactcttttctg

SEQ ID NO: 6610 - DNA, 20 bp, Homo Sapiens
  primer_bind 1..20: upstream amplification primer 99-13864 for SEQ 2676,
accccctgtcctcacatttc

SEQ ID NO: 6611 - DNA, 20 bp, Homo Sapiens
  primer_bind 1..20: upstream amplification primer 99-13938 for SEQ 2677,
cctgaatctaaaagcatctc

SEQ ID NO: 6612 - DNA, 18 bp, Homo Sapiens
  primer_bind 1..18: upstream amplification primer 99-13943 for SEQ 2678,
gacatgccacttgtatcg

SEQ ID NO: 6613 - DNA, 20 bp, Homo Sapiens
  primer_bind 1..20: upstream amplification primer 99-13948 for SEQ 2679,
cttctgagatttctggtttc

SEQ ID NO: 6614 - DNA, 20 bp, Homo Sapiens
  primer_bind 1..20: upstream amplification primer 99-13966 for SEQ 2680,
cattggtcagacatagccag

SEQ ID NO: 6615 - DNA, 20 bp, Homo Sapiens
  primer_bind 1..20: upstream amplification primer 99-14002 for SEQ 2681,
ctgtatttggaaggttcctg

SEQ ID NO: 6616 - DNA, 21 bp, Homo Sapiens
  primer_bind 1..21: upstream amplification primer 99-14022 for SEQ 2682,
cttcttttgaaacatcatcac

SEQ ID NO: 6617 - DNA, 19 bp, Homo Sapiens
  primer_bind 1..19: upstream amplification primer 99-14042 for SEQ 2683,
gactctttgattccctatg

SEQ ID NO: 6618 - DNA, 19 bp, Homo Sapiens
  primer_bind 1..19: upstream amplification primer 99-14045 for SEQ 2684,
gtgattggaaactgaagtg

SEQ ID NO: 6619 - DNA, 18 bp, Homo Sapiens
  primer_bind 1..18: upstream amplification primer 99-14074 for SEQ 2685,
actccaaatctatccctc

SEQ ID NO: 6620 - DNA, 18 bp, Homo Sapiens
  primer_bind 1..18: upstream amplification primer 99-14093 for SEQ 2686,
aggggacattttcattgg

SEQ ID NO: 6621 - DNA, 18 bp, Homo Sapiens
  primer_bind 1..18: upstream amplification primer 99-14105 for SEQ 2687,
agcactatccaacagaac

SEQ ID NO: 6622 - DNA, 18 bp, Homo Sapiens
  primer_bind 1..18: upstream amplification primer 99-14107 for SEQ 2688,
tgtgtgggatttgaaagg

SEQ ID NO: 6623 - DNA, 21 bp, Homo Sapiens
  primer_bind 1..21: upstream amplification primer 99-14111 for SEQ 2689,
gatataagactctaactcagg

SEQ ID NO: 6624 - DNA, 18 bp, Homo Sapiens
  primer_bind 1..18: upstream amplification primer 99-14177 for SEQ 2690,
atctgggtaaacttcagg

SEQ ID NO: 6625 - DNA, 18 bp, Homo Sapiens
  primer_bind 1..18: upstream amplification primer 99-14198 for SEQ 2691,
gttctttcactcagttcc

SEQ ID NO: 6626 - DNA, 20 bp, Homo Sapiens
  primer_bind 1..20: upstream amplification primer 99-14225 for SEQ 2692,
tttaattagctgtcacactc

SEQ ID NO: 6627 - DNA, 21 bp, Homo Sapiens
  primer_bind 1..21: upstream amplification primer 99-14228 for SEQ 2693,
gcttttcatgtagtaatatgc

SEQ ID NO: 6628 - DNA, 21 bp, Homo Sapiens
  primer_bind 1..21: upstream amplification primer 99-14410 for SEQ 2694,
gttggaaggtaatctctaagc

SEQ ID NO: 6629 - DNA, 20 bp, Homo Sapiens
  primer_bind 1..20: upstream amplification primer 99-14413 for SEQ 2695,
tagcctttcttgccccactc

SEQ ID NO: 6630 - DNA, 20 bp, Homo Sapiens
  primer_bind 1..20: upstream amplification primer 99-14415 for SEQ 2696,
tgccaggggtttcctaactc

SEQ ID NO: 6631 - DNA, 20 bp, Homo Sapiens
  primer_bind 1..20: upstream amplification primer 99-14424 for SEQ 2697,
aggctagtgactggacactg

SEQ ID NO: 6632 - DNA, 18 bp, Homo Sapiens
  primer_bind 1..18: upstream amplification primer 99-14473 for SEQ 2698,
cacatttaggtggcttgg

SEQ ID NO: 6633 - DNA, 18 bp, Homo Sapiens
  primer_bind 1..18: upstream amplification primer 99-14476 for SEQ 2699,
atctgagatgaggcttgg

SEQ ID NO: 6634 - DNA, 19 bp, Homo Sapiens
  primer_bind 1..19: upstream amplification primer 99-14481 for SEQ 2700,
cttgtatgtctgagtgaac

SEQ ID NO: 6635 - DNA, 20 bp, Homo Sapiens
  primer_bind 1..20: upstream amplification primer 99-14489 for SEQ 2701,
gttagagcagaaagtgtaag

SEQ ID NO: 6636 - DNA, 19 bp, Homo Sapiens
  primer_bind 1..19: upstream amplification primer 99-14673 for SEQ 2702,
cttgctctggtttacgatg

SEQ ID NO: 6637 - DNA, 19 bp, Homo Sapiens
  primer_bind 1..19: upstream amplification primer 99-14705 for SEQ 2703,
agttaaaggggagggtgac

SEQ ID NO: 6638 - DNA, 20 bp, Homo Sapiens
  primer_bind 1..20: upstream amplification primer 99-14739 for SEQ 2704,
gaaagatcattactacaagc

SEQ ID NO: 6639 - DNA, 21 bp, Homo Sapiens
  primer_bind 1..21: upstream amplification primer 99-14743 for SEQ 2705,
ctgaaagcctttttctaccac

SEQ ID NO: 6640 - DNA, 18 bp, Homo Sapiens
  primer_bind 1..18: upstream amplification primer 99-14944 for SEQ 2706,
ataggggttggtgaagag

SEQ ID NO: 6641 - DNA, 19 bp, Homo Sapiens
  primer_bind 1..19: upstream amplification primer 99-14949 for SEQ 2707,
attcactcacattatcctc

SEQ ID NO: 6642 - DNA, 18 bp, Homo Sapiens
  primer_bind 1..18: upstream amplification primer 99-15000 for SEQ 2708,
gatcacattctcctatgg

SEQ ID NO: 6643 - DNA, 21 bp, Homo Sapiens
  primer_bind 1..21: upstream amplification primer 99-15067 for SEQ 2709,
cctttctacttcctaatattc

SEQ ID NO: 6644 - DNA, 19 bp, Homo Sapiens
  primer_bind 1..19: upstream amplification primer 99-15192 for SEQ 2710,
tctggtctggaacactctg

SEQ ID NO: 6645 - DNA, 18 bp, Homo Sapiens
  primer_bind 1..18: upstream amplification primer 99-15369 for SEQ 2711,
aaaagggtggactctgtg

SEQ ID NO: 6646 - DNA, 18 bp, Homo Sapiens
  primer_bind 1..18: upstream amplification primer 99-15423 for SEQ 2712,
gaaggaatcagagggaac

SEQ ID NO: 6647 - DNA, 19 bp, Homo Sapiens
  primer_bind 1..19: upstream amplification primer 99-15471 for SEQ 2713,
tgagacaaagtagtttgag

SEQ ID NO: 6648 - DNA, 18 bp, Homo Sapiens
  primer_bind 1..18: upstream amplification primer 99-15538 for SEQ 2714,
ttgttgaaggcttggctg

SEQ ID NO: 6649 - DNA, 18 bp, Homo Sapiens
  primer_bind 1..18: upstream amplification primer 99-15588 for SEQ 2715,
aagatgaagcagtgttgg

SEQ ID NO: 6650 - DNA, 21 bp, Homo Sapiens
  primer_bind 1..21: upstream amplification primer 99-15615 for SEQ 2716,
ccttactgatttcattctttc

SEQ ID NO: 6651 - DNA, 21 bp, Homo Sapiens
  primer_bind 1..21: upstream amplification primer 99-15653 for SEQ 2717,
gctcaaaaacctccaaagacc

SEQ ID NO: 6652 - DNA, 18 bp, Homo Sapiens
  primer_bind 1..18: upstream amplification primer 99-15654 for SEQ 2718,
agaaacctgagcaaccac

SEQ ID NO: 6653 - DNA, 19 bp, Homo Sapiens
  primer_bind 1..19: upstream amplification primer 99-15724 for SEQ 2719,
aaaaatgcctgtttctctg

SEQ ID NO: 6654 - DNA, 19 bp, Homo Sapiens
  primer_bind 1..19: upstream amplification primer 99-15784 for SEQ 2720,
gacaaaaatggcaacatac

SEQ ID NO: 6655 - DNA, 18 bp, Homo Sapiens
  primer_bind 1..18: upstream amplification primer 99-1591 for SEQ 2721,
tcccatttctcaacacac

SEQ ID NO: 6656 - DNA, 19 bp, Homo Sapiens
  primer_bind 1..19: upstream amplification primer 99-15963 for SEQ 2722,
aatggcttagatgtatctc

SEQ ID NO: 6657 - DNA, 21 bp, Homo Sapiens
  primer_bind 1..21: upstream amplification primer 99-15984 for SEQ 2723,
gagctactgcttttaatagtg

SEQ ID NO: 6658 - DNA, 19 bp, Homo Sapiens
  primer_bind 1..19: upstream amplification primer 99-16017 for SEQ 2724,
ttggcttcttttatgatgg

SEQ ID NO: 6659 - DNA, 19 bp, Homo Sapiens
  primer_bind 1..19: upstream amplification primer 99-16026 for SEQ 2725,
agcttctctgatggcgttg

SEQ ID NO: 6660 - DNA, 19 bp, Homo Sapiens
  primer_bind 1..19: upstream amplification primer 99-1624 for SEQ 2726,
ttccttcctagtcctgatg

SEQ ID NO: 6661 - DNA, 18 bp, Homo Sapiens
  primer_bind 1..18: upstream amplification primer 99-16241 for SEQ 2727,
caaaggctttcctttcgg

SEQ ID NO: 6662 - DNA, 20 bp, Homo Sapiens
  primer_bind 1..20: upstream amplification primer 99-16259 for SEQ 2728,
gatctttctttgtgtctttg

SEQ ID NO: 6663 - DNA, 19 bp, Homo Sapiens
  primer_bind 1..19: upstream amplification primer 99-16284 for SEQ 2729,
gccaacattataaaccagg

SEQ ID NO: 6664 - DNA, 19 bp, Homo Sapiens
  primer_bind 1..19: upstream amplification primer 99-16343 for SEQ 2730,
tcttgcctgtgtcatcctg

SEQ ID NO: 6665 - DNA, 19 bp, Homo Sapiens
  primer_bind 1..19: upstream amplification primer 99-16401 for SEQ 2731,
ctctgtttaagtttctctg

SEQ ID NO: 6666 - DNA, 20 bp, Homo Sapiens
  primer_bind 1..20: upstream amplification primer 99-16406 for SEQ 2732,
ggggtgtgaacattttaagg

SEQ ID NO: 6667 - DNA, 20 bp, Homo Sapiens
  primer_bind 1..20: upstream amplification primer 99-16422 for SEQ 2733,
aacgcaggaattgtgacggg

SEQ ID NO: 6668 - DNA, 21 bp, Homo Sapiens
  primer_bind 1..21: upstream amplification primer 99-16428 for SEQ 2734,
agacttgcttccttcatctcc

SEQ ID NO: 6669 - DNA, 20 bp, Homo Sapiens
  primer_bind 1..20: upstream amplification primer 99-16430 for SEQ 2735,
agctaaaagctgctctcgcc

SEQ ID NO: 6670 - DNA, 18 bp, Homo Sapiens
  primer_bind 1..18: upstream amplification primer 99-16432 for SEQ 2736,
actttatctctccttccc

SEQ ID NO: 6671 - DNA, 18 bp, Homo Sapiens
  primer_bind 1..18: upstream amplification primer 99-16647 for SEQ 2737,
agcttttctgttgggatg

SEQ ID NO: 6672 - DNA, 18 bp, Homo Sapiens
  primer_bind 1..18: upstream amplification primer 99-16661 for SEQ 2738,
taagcgagtgacataggg

SEQ ID NO: 6673 - DNA, 20 bp, Homo Sapiens
  primer_bind 1..20: upstream amplification primer 99-16686 for SEQ 2739,
tgagaatctacttgaacagg

SEQ ID NO: 6674 - DNA, 18 bp, Homo Sapiens
  primer_bind 1..18: upstream amplification primer 99-16714 for SEQ 2740,
atttcccagagagttgag

SEQ ID NO: 6675 - DNA, 18 bp, Homo Sapiens
  primer_bind 1..18: upstream amplification primer 99-16735 for SEQ 2741,
taggagaggtgtgtatag

SEQ ID NO: 6676 - DNA, 19 bp, Homo Sapiens
  primer_bind 1..19: upstream amplification primer 99-16739 for SEQ 2742,
tattccaccctaccccaac

SEQ ID NO: 6677 - DNA, 19 bp, Homo Sapiens
  primer_bind 1..19: upstream amplification primer 99-16751 for SEQ 2743,
ggcacagaacattctcaac

SEQ ID NO: 6678 - DNA, 18 bp, Homo Sapiens
  primer_bind 1..18: upstream amplification primer 99-16752 for SEQ 2744,
ccaaaaagccttcatcag

SEQ ID NO: 6679 - DNA, 20 bp, Homo Sapiens
  primer_bind 1..20: upstream amplification primer 99-16754 for SEQ 2745,
ccagacaaaaaaaaatgccg

SEQ ID NO: 6680 - DNA, 21 bp, Homo Sapiens
  primer_bind 1..21: upstream amplification primer 99-16758 for SEQ 2746,
catttcatctacaactaaacc

SEQ ID NO: 6681 - DNA, 20 bp, Homo Sapiens
  primer_bind 1..20: upstream amplification primer 99-16761 for SEQ 2747,
tccacacacctcccacttag

SEQ ID NO: 6682 - DNA, 18 bp, Homo Sapiens
  primer_bind 1..18: upstream amplification primer 99-16769 for SEQ 2748,
aaagggaaaggagaatgg

SEQ ID NO: 6683 - DNA, 19 bp, Homo Sapiens
  primer_bind 1..19: upstream amplification primer 99-16771 for SEQ 2749,
ttatgactacttgctcagg

SEQ ID NO: 6684 - DNA, 19 bp, Homo Sapiens
  primer_bind 1..19: upstream amplification primer 99-16772 for SEQ 2750,
gcaacacaggaagaaaagg

SEQ ID NO: 6685 - DNA, 18 bp, Homo Sapiens
  primer_bind 1..18: upstream amplification primer 99-16774 for SEQ 2751,
cctggactagctttgatg

SEQ ID NO: 6686 - DNA, 18 bp, Homo Sapiens
  primer_bind 1..18: upstream amplification primer 99-16776 for SEQ 2752,
tgcatcgggcaaacaaac

SEQ ID NO: 6687 - DNA, 19 bp, Homo Sapiens
  primer_bind 1..19: upstream amplification primer 99-16794 for SEQ 2753,
tgtgagggaaaagagcctg

SEQ ID NO: 6688 - DNA, 19 bp, Homo Sapiens
  primer_bind 1..19: upstream amplification primer 99-16797 for SEQ 2754,
gtccagattatcctcttgc

SEQ ID NO: 6689 - DNA, 18 bp, Homo Sapiens
  primer_bind 1..18: upstream amplification primer 99-16815 for SEQ 2755,
tattatggtctcctcctg

SEQ ID NO: 6690 - DNA, 18 bp, Homo Sapiens
  primer_bind 1..18: upstream amplification primer 99-16835 for SEQ 2756,
tgacacagctatgcagac

SEQ ID NO: 6691 - DNA, 18 bp, Homo Sapiens
  primer_bind 1..18: upstream amplification primer 99-16909 for SEQ 2757,
cttcctcacttcattcag

SEQ ID NO: 6692 - DNA, 18 bp, Homo Sapiens
  primer_bind 1..18: upstream amplification primer 99-17024 for SEQ 2758,
tatggtggaaagacaagg

SEQ ID NO: 6693 - DNA, 20 bp, Homo Sapiens
  primer_bind 1..20: upstream amplification primer 99-17046 for SEQ 2759,
gtgcaagagaccattttaag

SEQ ID NO: 6694 - DNA, 19 bp, Homo Sapiens
  primer_bind 1..19: upstream amplification primer 99-17075 for SEQ 2760,
acagggagaaggtagacag

SEQ ID NO: 6695 - DNA, 21 bp, Homo Sapiens
  primer_bind 1..21: upstream amplification primer 99-17107 for SEQ 2761,
gacagaataacattgaactac

SEQ ID NO: 6696 - DNA, 18 bp, Homo Sapiens
  primer_bind 1..18: upstream amplification primer 99-17162 for SEQ 2762,
ctggatcattctgtgagg

SEQ ID NO: 6697 - DNA, 18 bp, Homo Sapiens
  primer_bind 1..18: upstream amplification primer 99-17167 for SEQ 2763,
atgtattcagatgctgcc

SEQ ID NO: 6698 - DNA, 19 bp, Homo Sapiens
  primer_bind 1..19: upstream amplification primer 99-17214 for SEQ 2764,
cgtgggtcatttttttttg

SEQ ID NO: 6699 - DNA, 18 bp, Homo Sapiens
  primer_bind 1..18: upstream amplification primer 99-17254 for SEQ 2765,
gtcctccttttatctccc

SEQ ID NO: 6700 - DNA, 18 bp, Homo Sapiens
  primer_bind 1..18: upstream amplification primer 99-17402 for SEQ 2766,
tgaaagtggatggaaagg

SEQ ID NO: 6701 - DNA, 18 bp, Homo Sapiens
  primer_bind 1..18: upstream amplification primer 99-17492 for SEQ 2767,
agatgtttttgctctgcc

SEQ ID NO: 6702 - DNA, 19 bp, Homo Sapiens
  primer_bind 1..19: upstream amplification primer 99-17519 for SEQ 2768,
agtccgcaagagcacatag

SEQ ID NO: 6703 - DNA, 19 bp, Homo Sapiens
  primer_bind 1..19: upstream amplification primer 99-17581 for SEQ 2769,
aaactatccttccatgttc

SEQ ID NO: 6704 - DNA, 18 bp, Homo Sapiens
  primer_bind 1..18: upstream amplification primer 99-17716 for SEQ 2770,
gtagaggtaattctgtgg

SEQ ID NO: 6705 - DNA, 18 bp, Homo Sapiens
  primer_bind 1..18: upstream amplification primer 99-18122 for SEQ 2771,
tatgactgatggaggagg

SEQ ID NO: 6706 - DNA, 19 bp, Homo Sapiens
  primer_bind 1..19: upstream amplification primer 99-18126 for SEQ 2772,
tctgactctttgcaggcac

SEQ ID NO: 6707 - DNA, 18 bp, Homo Sapiens
  primer_bind 1..18: upstream amplification primer 99-18127 for SEQ 2773,
catctgctccacatacac

SEQ ID NO: 6708 - DNA, 18 bp, Homo Sapiens
  primer_bind 1..18: upstream amplification primer 99-18141 for SEQ 2774,
tcttacttacccatctcc

SEQ ID NO: 6709 - DNA, 20 bp, Homo Sapiens
  primer_bind 1..20: upstream amplification primer 99-18190 for SEQ 2775,
ctagtatcaacactaacagg

SEQ ID NO: 6710 - DNA, 19 bp, Homo Sapiens
  primer_bind 1..19: upstream amplification primer 99-18321 for SEQ 2776,
atagtgtgagatgtaatgg

SEQ ID NO: 6711 - DNA, 19 bp, Homo Sapiens
  primer_bind 1..19: upstream amplification primer 99-1833 for SEQ 2777,
gattttctaatggtgggac

SEQ ID NO: 6712 - DNA, 18 bp, Homo Sapiens
  primer_bind 1..18: upstream amplification primer 99-18334 for SEQ 2778,
tgttccataaacgcaagg

SEQ ID NO: 6713 - DNA, 19 bp, Homo Sapiens
  primer_bind 1..19: upstream amplification primer 99-18396 for SEQ 2779,
ataaaacttgcttggactc

SEQ ID NO: 6714 - DNA, 19 bp, Homo Sapiens
  primer_bind 1..19: upstream amplification primer 99-18471 for SEQ 2780,
caccactcaacaagtattc

SEQ ID NO: 6715 - DNA, 18 bp, Homo Sapiens
  primer_bind 1..18: upstream amplification primer 99-18528 for SEQ 2781,
gctgactttaacttgctc

SEQ ID NO: 6716 - DNA, 18 bp, Homo Sapiens
  primer_bind 1..18: upstream amplification primer 99-18576 for SEQ 2782,
gggaaattgttctaaggg

SEQ ID NO: 6717 - DNA, 19 bp, Homo Sapiens
  primer_bind 1..19: upstream amplification primer 99-18581 for SEQ 2783,
attctccccttcagatgcc

SEQ ID NO: 6718 - DNA, 19 bp, Homo Sapiens
  primer_bind 1..19: upstream amplification primer 99-18645 for SEQ 2784,
gaagagtgttaccccaaag

SEQ ID NO: 6719 - DNA, 18 bp, Homo Sapiens
  primer_bind 1..18: upstream amplification primer 99-18696 for SEQ 2785,
agggaaacacaaagctgc

SEQ ID NO: 6720 - DNA, 20 bp, Homo Sapiens
  primer_bind 1..20: upstream amplification primer 99-18698 for SEQ 2786,
gacaaactcatttggatagg

SEQ ID NO: 6721 - DNA, 19 bp, Homo Sapiens
  primer_bind 1..19: upstream amplification primer 99-18710 for SEQ 2787,
ttgcattttgtaggcaatc

SEQ ID NO: 6722 - DNA, 18 bp, Homo Sapiens
  primer_bind 1..18: upstream amplification primer 99-18717 for SEQ 2788,
ttcatcccccttctcaac

SEQ ID NO: 6723 - DNA, 19 bp, Homo Sapiens
  primer_bind 1..19: upstream amplification primer 99-18718 for SEQ 2789,
cctgtgaaatgaaaatgcc

SEQ ID NO: 6724 - DNA, 18 bp, Homo Sapiens
  primer_bind 1..18: upstream amplification primer 99-18771 for SEQ 2790,
gctacttagtcaccatcc

SEQ ID NO: 6725 - DNA, 18 bp, Homo Sapiens
  primer_bind 1..18: upstream amplification primer 99-1879 for SEQ 2791,
agtattgatggtgagacg

SEQ ID NO: 6726 - DNA, 18 bp, Homo Sapiens
  primer_bind 1..18: upstream amplification primer 99-18886 for SEQ 2792,
aaataggtgcccaccatc

SEQ ID NO: 6727 - DNA, 19 bp, Homo Sapiens
  primer_bind 1..19: upstream amplification primer 99-18944 for SEQ 2793,
tcgcctaaggagtgaagag

SEQ ID NO: 6728 - DNA, 18 bp, Homo Sapiens
  primer_bind 1..18: upstream amplification primer 99-19023 for SEQ 2794,
tgcccttgaatgctttac

SEQ ID NO: 6729 - DNA, 18 bp, Homo Sapiens
  primer_bind 1..18: upstream amplification primer 99-19027 for SEQ 2795,
tcaaacagagacccattc

SEQ ID NO: 6730 - DNA, 19 bp, Homo Sapiens
  primer_bind 1..19: upstream amplification primer 99-19033 for SEQ 2796,
agccattgcccctttcttc

SEQ ID NO: 6731 - DNA, 19 bp, Homo Sapiens
  primer_bind 1..19: upstream amplification primer 99-19040 for SEQ 2797,
ggtttacaatgtggtactg

SEQ ID NO: 6732 - DNA, 20 bp, Homo Sapiens
  primer_bind 1..20: upstream amplification primer 99-19041 for SEQ 2798,
gcacattgttaaacatgctc

SEQ ID NO: 6733 - DNA, 20 bp, Homo Sapiens
  primer_bind 1..20: upstream amplification primer 99-19048 for SEQ 2799,
gggttataaaattacttggc

SEQ ID NO: 6734 - DNA, 19 bp, Homo Sapiens
  primer_bind 1..19: upstream amplification primer 99-19050 for SEQ 2800,
tatgaccaatattcaccag

SEQ ID NO: 6735 - DNA, 21 bp, Homo Sapiens
  primer_bind 1..21: upstream amplification primer 99-19053 for SEQ 2801,
gacctcatttaactggtcttg

SEQ ID NO: 6736 - DNA, 20 bp, Homo Sapiens
  primer_bind 1..20: upstream amplification primer 99-19055 for SEQ 2802,
cacctctttccaaacgatcc

SEQ ID NO: 6737 - DNA, 20 bp, Homo Sapiens
  primer_bind 1..20: upstream amplification primer 99-19059 for SEQ 2803,
catcagggaagagatgacgg

SEQ ID NO: 6738 - DNA, 20 bp, Homo Sapiens
  primer_bind 1..20: upstream amplification primer 99-19069 for SEQ 2804,
tgaccccacgttgaagttag

SEQ ID NO: 6739 - DNA, 21 bp, Homo Sapiens
  primer_bind 1..21: upstream amplification primer 99-19095 for SEQ 2805,
tgaccagacatgacagaatag

SEQ ID NO: 6740 - DNA, 21 bp, Homo Sapiens
  primer_bind 1..21: upstream amplification primer 99-19096 for SEQ 2806,
cttcctctagttttcttcatc

SEQ ID NO: 6741 - DNA, 19 bp, Homo Sapiens
  primer_bind 1..19: upstream amplification primer 99-19104 for SEQ 2807,
gctgaaacaaacagtcctc

SEQ ID NO: 6742 - DNA, 19 bp, Homo Sapiens
  primer_bind 1..19: upstream amplification primer 99-19105 for SEQ 2808,
tcatcttcaggcacgagac

SEQ ID NO: 6743 - DNA, 20 bp, Homo Sapiens
  primer_bind 1..20: upstream amplification primer 99-19108 for SEQ 2809,
ccaaggagagtaatgaagtg

SEQ ID NO: 6744 - DNA, 21 bp, Homo Sapiens
  primer_bind 1..21: upstream amplification primer 99-19110 for SEQ 2810,
gttacaagtgctgaccttatc

SEQ ID NO: 6745 - DNA, 19 bp, Homo Sapiens
  primer_bind 1..19: upstream amplification primer 99-19122 for SEQ 2811,
gaagagaggttgtttagag

SEQ ID NO: 6746 - DNA, 19 bp, Homo Sapiens
  primer_bind 1..19: upstream amplification primer 99-19123 for SEQ 2812,
gacttctaggggaaagcac

SEQ ID NO: 6747 - DNA, 19 bp, Homo Sapiens
  primer_bind 1..19: upstream amplification primer 99-19130 for SEQ 2813,
cctttcagagtaccaattc

SEQ ID NO: 6748 - DNA, 19 bp, Homo Sapiens
  primer_bind 1..19: upstream amplification primer 99-19137 for SEQ 2814,
cttgtcagttctagtgacc

SEQ ID NO: 6749 - DNA, 19 bp, Homo Sapiens
  primer_bind 1..19: upstream amplification primer 99-19142 for SEQ 2815,
tgctgccctacaaaacacc

SEQ ID NO: 6750 - DNA, 21 bp, Homo Sapiens
  primer_bind 1..21: upstream amplification primer 99-19154 for SEQ 2816,
ctagtgaccatctactattcc

SEQ ID NO: 6751 - DNA, 20 bp, Homo Sapiens
  primer_bind 1..20: upstream amplification primer 99-19155 for SEQ 2817,
ggtagctgcgaatttaagac

SEQ ID NO: 6752 - DNA, 20 bp, Homo Sapiens
  primer_bind 1..20: upstream amplification primer 99-19167 for SEQ 2818,
aaagtatgagctggctcggg

SEQ ID NO: 6753 - DNA, 21 bp, Homo Sapiens
  primer_bind 1..21: upstream amplification primer 99-19170 for SEQ 2819,
ataccatgatggaggatggag

SEQ ID NO: 6754 - DNA, 19 bp, Homo Sapiens
  primer_bind 1..19: upstream amplification primer 99-19171 for SEQ 2820,
ggctgtggaactaaatggc

SEQ ID NO: 6755 - DNA, 20 bp, Homo Sapiens
  primer_bind 1..20: upstream amplification primer 99-19175 for SEQ 2821,
ttggatcttcccaccaagcg

SEQ ID NO: 6756 - DNA, 19 bp, Homo Sapiens
  primer_bind 1..19: upstream amplification primer 99-19177 for SEQ 2822,
tgtaatcagaatgacctcc

SEQ ID NO: 6757 - DNA, 20 bp, Homo Sapiens
  primer_bind 1..20: upstream amplification primer 99-19178 for SEQ 2823,
tggcaacactgttacttttc

SEQ ID NO: 6758 - DNA, 20 bp, Homo Sapiens
  primer_bind 1..20: upstream amplification primer 99-19210 for SEQ 2824,
tccctcagaaactctcctcc

SEQ ID NO: 6759 - DNA, 20 bp, Homo Sapiens
  primer_bind 1..20: upstream amplification primer 99-19219 for SEQ 2825,
tggcaggaactagatgggac

SEQ ID NO: 6760 - DNA, 20 bp, Homo Sapiens
  primer_bind 1..20: upstream amplification primer 99-19220 for SEQ 2826,
ccttctcatacactaattcc

SEQ ID NO: 6761 - DNA, 21 bp, Homo Sapiens
  primer_bind 1..21: upstream amplification primer 99-19223 for SEQ 2827,
cctatgccaccaaagtttaag

SEQ ID NO: 6762 - DNA, 20 bp, Homo Sapiens
  primer_bind 1..20: upstream amplification primer 99-19226 for SEQ 2828,
ttaaacctgtgcctgtaacc

SEQ ID NO: 6763 - DNA, 20 bp, Homo Sapiens
  primer_bind 1..20: upstream amplification primer 99-19228 for SEQ 2829,
gaaaaaggtctctaggactg

SEQ ID NO: 6764 - DNA, 20 bp, Homo Sapiens
  primer_bind 1..20: upstream amplification primer 99-19236 for SEQ 2830,
tgcctctcttcctaatcccc

SEQ ID NO: 6765 - DNA, 20 bp, Homo Sapiens
  primer_bind 1..20: upstream amplification primer 99-19241 for SEQ 2831,
ttcccctcctttatctcccc

SEQ ID NO: 6766 - DNA, 18 bp, Homo Sapiens
  primer_bind 1..18: upstream amplification primer 99-19242 for SEQ 2832,
gaaaagggcgtcctttac

SEQ ID NO: 6767 - DNA, 20 bp, Homo Sapiens
  primer_bind 1..20: upstream amplification primer 99-19283 for SEQ 2833,
ctttgacaggagaattaagg

SEQ ID NO: 6768 - DNA, 21 bp, Homo Sapiens
  primer_bind 1..21: upstream amplification primer 99-19295 for SEQ 2834,
ccagcagaagcagaaatatag

SEQ ID NO: 6769 - DNA, 19 bp, Homo Sapiens
  primer_bind 1..19: upstream amplification primer 99-19304 for SEQ 2835,
gtttcgctcatttatgtgg

SEQ ID NO: 6770 - DNA, 20 bp, Homo Sapiens
  primer_bind 1..20: upstream amplification primer 99-19305 for SEQ 2836,
tttcgctgggtatcctcgtc

SEQ ID NO: 6771 - DNA, 19 bp, Homo Sapiens
  primer_bind 1..19: upstream amplification primer 99-19309 for SEQ 2837,
actcatctgactgtatctc

SEQ ID NO: 6772 - DNA, 19 bp, Homo Sapiens
  primer_bind 1..19: upstream amplification primer 99-19312 for SEQ 2838,
taagtggaatttagagtgg

SEQ ID NO: 6773 - DNA, 18 bp, Homo Sapiens
  primer_bind 1..18: upstream amplification primer 99-19324 for SEQ 2839,
atggaacagaggaaatgg

SEQ ID NO: 6774 - DNA, 20 bp, Homo Sapiens
  primer_bind 1..20: upstream amplification primer 99-19330 for SEQ 2840,
gaaaggtactcttttgcttg

SEQ ID NO: 6775 - DNA, 19 bp, Homo Sapiens
  primer_bind 1..19: upstream amplification primer 99-19347 for SEQ 2841,
ctgattatgagaggtgaag

SEQ ID NO: 6776 - DNA, 19 bp, Homo Sapiens
  primer_bind 1..19: upstream amplification primer 99-19348 for SEQ 2842,
cttgtggcttaatactatc

SEQ ID NO: 6777 - DNA, 21 bp, Homo Sapiens
  primer_bind 1..21: upstream amplification primer 99-19351 for SEQ 2843,
attttctctgtaaccccctac

SEQ ID NO: 6778 - DNA, 19 bp, Homo Sapiens
  primer_bind 1..19: upstream amplification primer 99-19368 for SEQ 2844,
gaaatacacgaataccaac

SEQ ID NO: 6779 - DNA, 21 bp, Homo Sapiens
  primer_bind 1..21: upstream amplification primer 99-19375 for SEQ 2845,
cattttgtgaacttgtgtttc

SEQ ID NO: 6780 - DNA, 19 bp, Homo Sapiens
  primer_bind 1..19: upstream amplification primer 99-19381 for SEQ 2846,
tgcactgcttatatgatac

SEQ ID NO: 6781 - DNA, 21 bp, Homo Sapiens
  primer_bind 1..21: upstream amplification primer 99-19383 for SEQ 2847,
gtagaaaaaatttagacgtgg

SEQ ID NO: 6782 - DNA, 19 bp, Homo Sapiens
  primer_bind 1..19: upstream amplification primer 99-19384 for SEQ 2848,
cacgatgcctgctttttac

SEQ ID NO: 6783 - DNA, 21 bp, Homo Sapiens
  primer_bind 1..21: upstream amplification primer 99-19418 for SEQ 2849,
aagggcagattttcattatgg

SEQ ID NO: 6784 - DNA, 20 bp, Homo Sapiens
  primer_bind 1..20: upstream amplification primer 99-19420 for SEQ 2850,
gttaagtgaattaatggagg

SEQ ID NO: 6785 - DNA, 21 bp, Homo Sapiens
  primer_bind 1..21: upstream amplification primer 99-19426 for SEQ 2851,
ccccaggagatttatatggtg

SEQ ID NO: 6786 - DNA, 21 bp, Homo Sapiens
  primer_bind 1..21: upstream amplification primer 99-19431 for SEQ 2852,
tggatgtacttagtccagttg

SEQ ID NO: 6787 - DNA, 19 bp, Homo Sapiens
  primer_bind 1..19: upstream amplification primer 99-19438 for SEQ 2853,
tatagttggtacatcttgg

SEQ ID NO: 6788 - DNA, 21 bp, Homo Sapiens
  primer_bind 1..21: upstream amplification primer 99-19442 for SEQ 2854,
gttagatattcctggtagatg

SEQ ID NO: 6789 - DNA, 19 bp, Homo Sapiens
  primer_bind 1..19: upstream amplification primer 99-19444 for SEQ 2855,
actactcctaatcttactc

SEQ ID NO: 6790 - DNA, 20 bp, Homo Sapiens
  primer_bind 1..20: upstream amplification primer 99-19450 for SEQ 2856,
gcatagggtattaaatctac

SEQ ID NO: 6791 - DNA, 19 bp, Homo Sapiens
  primer_bind 1..19: upstream amplification primer 99-19453 for SEQ 2857,
tactattaccacttactgc

SEQ ID NO: 6792 - DNA, 19 bp, Homo Sapiens
  primer_bind 1..19: upstream amplification primer 99-19457 for SEQ 2858,
tgagatgtcattagatagg

SEQ ID NO: 6793 - DNA, 20 bp, Homo Sapiens
  primer_bind 1..20: upstream amplification primer 99-19460 for SEQ 2859,
agaacagtcagacccagctc

SEQ ID NO: 6794 - DNA, 21 bp, Homo Sapiens
  primer_bind 1..21: upstream amplification primer 99-19461 for SEQ 2860,
tgatctggggagatacttttc

SEQ ID NO: 6795 - DNA, 20 bp, Homo Sapiens
  primer_bind 1..20: upstream amplification primer 99-19464 for SEQ 2861,
gttgttctttgccaaaagag

SEQ ID NO: 6796 - DNA, 19 bp, Homo Sapiens
  primer_bind 1..19: upstream amplification primer 99-19466 for SEQ 2862,
atcaactatcatcaaacgg

SEQ ID NO: 6797 - DNA, 20 bp, Homo Sapiens
  primer_bind 1..20: upstream amplification primer 99-19474 for SEQ 2863,
cagtaataaacccaagcgtc

SEQ ID NO: 6798 - DNA, 19 bp, Homo Sapiens
  primer_bind 1..19: upstream amplification primer 99-19475 for SEQ 2864,
ctctgaccactattctctc

SEQ ID NO: 6799 - DNA, 20 bp, Homo Sapiens
  primer_bind 1..20: upstream amplification primer 99-19477 for SEQ 2865,
agggttgtaagagaccccag

SEQ ID NO: 6800 - DNA, 19 bp, Homo Sapiens
  primer_bind 1..19: upstream amplification primer 99-19504 for SEQ 2866,
acatacttcggaatgtaag

SEQ ID NO: 6801 - DNA, 19 bp, Homo Sapiens
  primer_bind 1..19: upstream amplification primer 99-19528 for SEQ 2867,
agctcatctgttcggtgtg

SEQ ID NO: 6802 - DNA, 19 bp, Homo Sapiens
  primer_bind 1..19: upstream amplification primer 99-19529 for SEQ 2868,
gttatgagttcccatagtc

SEQ ID NO: 6803 - DNA, 21 bp, Homo Sapiens
  primer_bind 1..21: upstream amplification primer 99-19532 for SEQ 2869,
gtaaagacaagagttgaccac

SEQ ID NO: 6804 - DNA, 20 bp, Homo Sapiens
  primer_bind 1..20: upstream amplification primer 99-19538 for SEQ 2870,
ctcttgattggttgatattc

SEQ ID NO: 6805 - DNA, 20 bp, Homo Sapiens
  primer_bind 1..20: upstream amplification primer 99-19544 for SEQ 2871,
cagttttctcagtttatgac

SEQ ID NO: 6806 - DNA, 20 bp, Homo Sapiens
  primer_bind 1..20: upstream amplification primer 99-19546 for SEQ 2872,
cctttattacaccctttaac

SEQ ID NO: 6807 - DNA, 21 bp, Homo Sapiens
  primer_bind 1..21: upstream amplification primer 99-19550 for SEQ 2873,
gagcttatgccaaacacaaag

SEQ ID NO: 6808 - DNA, 19 bp, Homo Sapiens
  primer_bind 1..19: upstream amplification primer 99-19553 for SEQ 2874,
ctgaaattcttgttggttc

SEQ ID NO: 6809 - DNA, 20 bp, Homo Sapiens
  primer_bind 1..20: upstream amplification primer 99-19557 for SEQ 2875,
aatcagcccatctgctcctc

SEQ ID NO: 6810 - DNA, 20 bp, Homo Sapiens
  primer_bind 1..20: upstream amplification primer 99-19560 for SEQ 2876,
cagtttggataacaatgaag

SEQ ID NO: 6811 - DNA, 18 bp, Homo Sapiens
  primer_bind 1..18: upstream amplification primer 99-19562 for SEQ 2877,
cttatcggtagactagac

SEQ ID NO: 6812 - DNA, 21 bp, Homo Sapiens
  primer_bind 1..21: upstream amplification primer 99-19566 for SEQ 2878,
catccttctatttcagtctcc

SEQ ID NO: 6813 - DNA, 19 bp, Homo Sapiens
  primer_bind 1..19: upstream amplification primer 99-19568 for SEQ 2879,
gacacactattaccacatc

SEQ ID NO: 6814 - DNA, 21 bp, Homo Sapiens
  primer_bind 1..21: upstream amplification primer 99-19575 for SEQ 2880,
ggctgtccctttagtagtatg

SEQ ID NO: 6815 - DNA, 21 bp, Homo Sapiens
  primer_bind 1..21: upstream amplification primer 99-19578 for SEQ 2881,
ccttcattaagattggattac

SEQ ID NO: 6816 - DNA, 19 bp, Homo Sapiens
  primer_bind 1..19: upstream amplification primer 99-19580 for SEQ 2882,
aaagaaacccagtaaatcc

SEQ ID NO: 6817 - DNA, 20 bp, Homo Sapiens
  primer_bind 1..20: upstream amplification primer 99-19584 for SEQ 2883,
cttatcactattggtttggg

SEQ ID NO: 6818 - DNA, 21 bp, Homo Sapiens
  primer_bind 1..21: upstream amplification primer 99-19588 for SEQ 2884,
ctttaacctaaggaatttgtg

SEQ ID NO: 6819 - DNA, 20 bp, Homo Sapiens
  primer_bind 1..20: upstream amplification primer 99-19589 for SEQ 2885,
ttggcaacactcatctcacg

SEQ ID NO: 6820 - DNA, 19 bp, Homo Sapiens
  primer_bind 1..19: upstream amplification primer 99-19601 for SEQ 2886,
ctaaactcatactaaggtg

SEQ ID NO: 6821 - DNA, 21 bp, Homo Sapiens
  primer_bind 1..21: upstream amplification primer 99-19624 for SEQ 2887,
ggaggagaaagcagttaccag

SEQ ID NO: 6822 - DNA, 20 bp, Homo Sapiens
  primer_bind 1..20: upstream amplification primer 99-19634 for SEQ 2888,
ttgaagtgatgtgaaacccc

SEQ ID NO: 6823 - DNA, 19 bp, Homo Sapiens
  primer_bind 1..19: upstream amplification primer 99-19639 for SEQ 2889,
aaaaatgattccctagtgg

SEQ ID NO: 6824 - DNA, 20 bp, Homo Sapiens
  primer_bind 1..20: upstream amplification primer 99-19645 for SEQ 2890,
gagggaatggtatatttggg

SEQ ID NO: 6825 - DNA, 21 bp, Homo Sapiens
  primer_bind 1..21: upstream amplification primer 99-19650 for SEQ 2891,
ggacaaaaacctcttaaaatc

SEQ ID NO: 6826 - DNA, 20 bp, Homo Sapiens
  primer_bind 1..20: upstream amplification primer 99-19651 for SEQ 2892,
gaggatagttccattgatag

SEQ ID NO: 6827 - DNA, 21 bp, Homo Sapiens
  primer_bind 1..21: upstream amplification primer 99-19664 for SEQ 2893,
caaaatatgaagcgaataagg

SEQ ID NO: 6828 - DNA, 20 bp, Homo Sapiens
  primer_bind 1..20: upstream amplification primer 99-19673 for SEQ 2894,
ctattgttaccactgacaag

SEQ ID NO: 6829 - DNA, 20 bp, Homo Sapiens
  primer_bind 1..20: upstream amplification primer 99-19678 for SEQ 2895,
ttcctcctgttagctgggtg

SEQ ID NO: 6830 - DNA, 21 bp, Homo Sapiens
  primer_bind 1..21: upstream amplification primer 99-19685 for SEQ 2896,
cctcaaagtttaagaagcctg

SEQ ID NO: 6831 - DNA, 20 bp, Homo Sapiens
  primer_bind 1..20: upstream amplification primer 99-19697 for SEQ 2897,
cgtatataaactgaactctg

SEQ ID NO: 6832 - DNA, 19 bp, Homo Sapiens
  primer_bind 1..19: upstream amplification primer 99-19703 for SEQ 2898,
acctccaatctcctggttg

SEQ ID NO: 6833 - DNA, 21 bp, Homo Sapiens
  primer_bind 1..21: upstream amplification primer 99-19705 for SEQ 2899,
catacatggaaatatcatcag

SEQ ID NO: 6834 - DNA, 20 bp, Homo Sapiens
  primer_bind 1..20: upstream amplification primer 99-19709 for SEQ 2900,
atctaacccctagaattaac

SEQ ID NO: 6835 - DNA, 21 bp, Homo Sapiens
  primer_bind 1..21: upstream amplification primer 99-19711 for SEQ 2901,
ctccctttcaagtgtagatag

SEQ ID NO: 6836 - DNA, 20 bp, Homo Sapiens
  primer_bind 1..20: upstream amplification primer 99-19722 for SEQ 2902,
ctctagttgctgtaatttcc

SEQ ID NO: 6837 - DNA, 20 bp, Homo Sapiens
  primer_bind 1..20: upstream amplification primer 99-19731 for SEQ 2903,
ttcaggcaaggtgggcaaag

SEQ ID NO: 6838 - DNA, 20 bp, Homo Sapiens
  primer_bind 1..20: upstream amplification primer 99-19732 for SEQ 2904,
cggttaaaacctttttcctc

SEQ ID NO: 6839 - DNA, 21 bp, Homo Sapiens
  primer_bind 1..21: upstream amplification primer 99-19736 for SEQ 2905,
ctgaagacatatattattgcc

SEQ ID NO: 6840 - DNA, 19 bp, Homo Sapiens
  primer_bind 1..19: upstream amplification primer 99-19745 for SEQ 2906,
ccattaacccactacatcc

SEQ ID NO: 6841 - DNA, 19 bp, Homo Sapiens
  primer_bind 1..19: upstream amplification primer 99-19749 for SEQ 2907,
taaacccaggcacttccac

SEQ ID NO: 6842 - DNA, 21 bp, Homo Sapiens
  primer_bind 1..21: upstream amplification primer 99-19752 for SEQ 2908,
ccttttatgctgcttttctgc

SEQ ID NO: 6843 - DNA, 21 bp, Homo Sapiens
  primer_bind 1..21: upstream amplification primer 99-19753 for SEQ 2909,
cagtaaacctaatgtggtgtc

SEQ ID NO: 6844 - DNA, 20 bp, Homo Sapiens
  primer_bind 1..20: upstream amplification primer 99-19756 for SEQ 2910,
cgaatcagctccagaatttg

SEQ ID NO: 6845 - DNA, 21 bp, Homo Sapiens
  primer_bind 1..21: upstream amplification primer 99-19764 for SEQ 2911,
agttttcaaagccaaatgaag

SEQ ID NO: 6846 - DNA, 21 bp, Homo Sapiens
  primer_bind 1..21: upstream amplification primer 99-19769 for SEQ 2912,
ctctcagttttgcttaaaatc

SEQ ID NO: 6847 - DNA, 20 bp, Homo Sapiens
  primer_bind 1..20: upstream amplification primer 99-19780 for SEQ 2913,
tgccccatctccatgatacc

SEQ ID NO: 6848 - DNA, 18 bp, Homo Sapiens
  primer_bind 1..18: upstream amplification primer 99-19785 for SEQ 2914,
tggatgagggaaaccttg

SEQ ID NO: 6849 - DNA, 19 bp, Homo Sapiens
  primer_bind 1..19: upstream amplification primer 99-19790 for SEQ 2915,
agagagtacaggctcacac

SEQ ID NO: 6850 - DNA, 19 bp, Homo Sapiens
  primer_bind 1..19: upstream amplification primer 99-19791 for SEQ 2916,
ctcagatccacaatgaaac

SEQ ID NO: 6851 - DNA, 18 bp, Homo Sapiens
  primer_bind 1..18: upstream amplification primer 99-19795 for SEQ 2917,
gtagagtaggcggtaaag

SEQ ID NO: 6852 - DNA, 20 bp, Homo Sapiens
  primer_bind 1..20: upstream amplification primer 99-19796 for SEQ 2918,
gtaaccagtatgaatgtacc

SEQ ID NO: 6853 - DNA, 19 bp, Homo Sapiens
  primer_bind 1..19: upstream amplification primer 99-19807 for SEQ 2919,
tccaactgatagactaaac

SEQ ID NO: 6854 - DNA, 21 bp, Homo Sapiens
  primer_bind 1..21: upstream amplification primer 99-19813 for SEQ 2920,
cacaacttctaatgtcaactg

SEQ ID NO: 6855 - DNA, 19 bp, Homo Sapiens
  primer_bind 1..19: upstream amplification primer 99-19818 for SEQ 2921,
attgtgagatagcacatac

SEQ ID NO: 6856 - DNA, 19 bp, Homo Sapiens
  primer_bind 1..19: upstream amplification primer 99-19826 for SEQ 2922,
tttccaacctcgtctagcc

SEQ ID NO: 6857 - DNA, 20 bp, Homo Sapiens
  primer_bind 1..20: upstream amplification primer 99-19839 for SEQ 2923,
atcaggaaggtactgggtgg

SEQ ID NO: 6858 - DNA, 20 bp, Homo Sapiens
  primer_bind 1..20: upstream amplification primer 99-19851 for SEQ 2924,
gactttctgttggtaaactg

SEQ ID NO: 6859 - DNA, 20 bp, Homo Sapiens
  primer_bind 1..20: upstream amplification primer 99-19858 for SEQ 2925,
tacttttatccatagactgc

SEQ ID NO: 6860 - DNA, 20 bp, Homo Sapiens
  primer_bind 1..20: upstream amplification primer 99-19860 for SEQ 2926,
tgacacagaaatggagctgg

SEQ ID NO: 6861 - DNA, 20 bp, Homo Sapiens
  primer_bind 1..20: upstream amplification primer 99-19864 for SEQ 2927,
caatacagattcatggaaac

SEQ ID NO: 6862 - DNA, 19 bp, Homo Sapiens
  primer_bind 1..19: upstream amplification primer 99-19871 for SEQ 2928,
agcacccatcccataaagc

SEQ ID NO: 6863 - DNA, 18 bp, Homo Sapiens
  primer_bind 1..18: upstream amplification primer 99-19872 for SEQ 2929,
acaaggggatagttcacc

SEQ ID NO: 6864 - DNA, 19 bp, Homo Sapiens
  primer_bind 1..19: upstream amplification primer 99-19875 for SEQ 2930,
taatagtgtgtgctgaatc

SEQ ID NO: 6865 - DNA, 20 bp, Homo Sapiens
  primer_bind 1..20: upstream amplification primer 99-19876 for SEQ 2931,
agaaggggctgaggtagatg

SEQ ID NO: 6866 - DNA, 20 bp, Homo Sapiens
  primer_bind 1..20: upstream amplification primer 99-19890 for SEQ 2932,
ctaattatgatctctagtcc

SEQ ID NO: 6867 - DNA, 19 bp, Homo Sapiens
  primer_bind 1..19: upstream amplification primer 99-19896 for SEQ 2933,
ggtacttatgttgaagcag

SEQ ID NO: 6868 - DNA, 21 bp, Homo Sapiens
  primer_bind 1..21: upstream amplification primer 99-19901 for SEQ 2934,
ccttccatattgcatttggtc

SEQ ID NO: 6869 - DNA, 19 bp, Homo Sapiens
  primer_bind 1..19: upstream amplification primer 99-19906 for SEQ 2935,
ctaacgccttatagcaatg

SEQ ID NO: 6870 - DNA, 20 bp, Homo Sapiens
  primer_bind 1..20: upstream amplification primer 99-19911 for SEQ 2936,
gaatgaagtatggtaaacac

SEQ ID NO: 6871 - DNA, 21 bp, Homo Sapiens
  primer_bind 1..21: upstream amplification primer 99-19916 for SEQ 2937,
ctattaactcaaaccacaaac

SEQ ID NO: 6872 - DNA, 21 bp, Homo Sapiens
  primer_bind 1..21: upstream amplification primer 99-19922 for SEQ 2938,
cattccttcttgtgtcttctg

SEQ ID NO: 6873 - DNA, 19 bp, Homo Sapiens
  primer_bind 1..19: upstream amplification primer 99-19923 for SEQ 2939,
actaataatatgagcaccc

SEQ ID NO: 6874 - DNA, 20 bp, Homo Sapiens
  primer_bind 1..20: upstream amplification primer 99-19933 for SEQ 2940,
aggtggtctgacccaaaagc

SEQ ID NO: 6875 - DNA, 20 bp, Homo Sapiens
  primer_bind 1..20: upstream amplification primer 99-19937 for SEQ 2941,
gattagaccgtagtgaacag

SEQ ID NO: 6876 - DNA, 19 bp, Homo Sapiens
  primer_bind 1..19: upstream amplification primer 99-19944 for SEQ 2942,
cacttctaaccttctactc

SEQ ID NO: 6877 - DNA, 19 bp, Homo Sapiens
  primer_bind 1..19: upstream amplification primer 99-19951 for SEQ 2943,
gtactaatactggaactgg

SEQ ID NO: 6878 - DNA, 18 bp, Homo Sapiens
  primer_bind 1..18: upstream amplification primer 99-20038 for SEQ 2944,
acaacttcatgtggcagg

SEQ ID NO: 6879 - DNA, 19 bp, Homo Sapiens
  primer_bind 1..19: upstream amplification primer 99-20072 for SEQ 2945,
agatggcttctaaattcac

SEQ ID NO: 6880 - DNA, 19 bp, Homo Sapiens
  primer_bind 1..19: upstream amplification primer 99-20226 for SEQ 2946,
tgcgaggaaagtcagtgag

SEQ ID NO: 6881 - DNA, 20 bp, Homo Sapiens
  primer_bind 1..20: upstream amplification primer 99-20228 for SEQ 2947,
ctatcaaaccgattttaacc

SEQ ID NO: 6882 - DNA, 18 bp, Homo Sapiens
  primer_bind 1..18: upstream amplification primer 99-20234 for SEQ 2948,
aagtgacactgtccttac

SEQ ID NO: 6883 - DNA, 19 bp, Homo Sapiens
  primer_bind 1..19: upstream amplification primer 99-20537 for SEQ 2949,
atggttggtaatctttctc

SEQ ID NO: 6884 - DNA, 21 bp, Homo Sapiens
  primer_bind 1..21: upstream amplification primer 99-20733 for SEQ 2950,
catttcttcagcaaaaattgg

SEQ ID NO: 6885 - DNA, 19 bp, Homo Sapiens
  primer_bind 1..19: upstream amplification primer 99-20815 for SEQ 2951,
tttatcttatctctctgcc

SEQ ID NO: 6886 - DNA, 20 bp, Homo Sapiens
  primer_bind 1..20: upstream amplification primer 99-20896 for SEQ 2952,
tgagaaaaagcccagccgag

SEQ ID NO: 6887 - DNA, 19 bp, Homo Sapiens
  primer_bind 1..19: upstream amplification primer 99-20958 for SEQ 2953,
agctcagtaaatgttagac

SEQ ID NO: 6888 - DNA, 19 bp, Homo Sapiens
  primer_bind 1..19: upstream amplification primer 99-21057 for SEQ 2954,
gaacaacataagaaggaac

SEQ ID NO: 6889 - DNA, 20 bp, Homo Sapiens
  primer_bind 1..20: upstream amplification primer 99-21059 for SEQ 2955,
ttccacttaaacgcagaagg

SEQ ID NO: 6890 - DNA, 18 bp, Homo Sapiens
  primer_bind 1..18: upstream amplification primer 99-21110 for SEQ 2956,
aggcaagtgtttagcgtg

SEQ ID NO: 6891 - DNA, 19 bp, Homo Sapiens
  primer_bind 1..19: upstream amplification primer 99-21123 for SEQ 2957,
cacacacagaagaatgaag

SEQ ID NO: 6892 - DNA, 18 bp, Homo Sapiens
  primer_bind 1..18: upstream amplification primer 99-21133 for SEQ 2958,
ccttaacatatcagctcc

SEQ ID NO: 6893 - DNA, 20 bp, Homo Sapiens
  primer_bind 1..20: upstream amplification primer 99-21181 for SEQ 2959,
ctgaggtatggtatatttgc

SEQ ID NO: 6894 - DNA, 21 bp, Homo Sapiens
  primer_bind 1..21: upstream amplification primer 99-21192 for SEQ 2960,
tcccgagttaatgagtatcac

SEQ ID NO: 6895 - DNA, 20 bp, Homo Sapiens
  primer_bind 1..20: upstream amplification primer 99-21227 for SEQ 2961,
gaatctgatgaaaatgctgg

SEQ ID NO: 6896 - DNA, 19 bp, Homo Sapiens
  primer_bind 1..19: upstream amplification primer 99-21229 for SEQ 2962,
gggttagatcaattatagg

SEQ ID NO: 6897 - DNA, 21 bp, Homo Sapiens
  primer_bind 1..21: upstream amplification primer 99-21240 for SEQ 2963,
gaaaaagggaaatcagtaaag

SEQ ID NO: 6898 - DNA, 19 bp, Homo Sapiens
  primer_bind 1..19: upstream amplification primer 99-21242 for SEQ 2964,
attcctatttaccaccttc

SEQ ID NO: 6899 - DNA, 18 bp, Homo Sapiens
  primer_bind 1..18: upstream amplification primer 99-21244 for SEQ 2965,
tgcctatctgcaaggttc

SEQ ID NO: 6900 - DNA, 20 bp, Homo Sapiens
  primer_bind 1..20: upstream amplification primer 99-21252 for SEQ 2966,
agtccattctgcacacaacc

SEQ ID NO: 6901 - DNA, 21 bp, Homo Sapiens
  primer_bind 1..21: upstream amplification primer 99-21267 for SEQ 2967,
gtactatataatgagggaatg

SEQ ID NO: 6902 - DNA, 20 bp, Homo Sapiens
  primer_bind 1..20: upstream amplification primer 99-21284 for SEQ 2968,
cgtaaggctgaaacttgctc

SEQ ID NO: 6903 - DNA, 21 bp, Homo Sapiens
  primer_bind 1..21: upstream amplification primer 99-21293 for SEQ 2969,
cttaataaattctaaccccac

SEQ ID NO: 6904 - DNA, 20 bp, Homo Sapiens
  primer_bind 1..20: upstream amplification primer 99-21307 for SEQ 2970,
gtggtgtttggtttagtttg

SEQ ID NO: 6905 - DNA, 19 bp, Homo Sapiens
  primer_bind 1..19: upstream amplification primer 99-21310 for SEQ 2971,
taggcgttttctcccactc

SEQ ID NO: 6906 - DNA, 19 bp, Homo Sapiens
  primer_bind 1..19: upstream amplification primer 99-21312 for SEQ 2972,
agagtgcagtacatggtgg

SEQ ID NO: 6907 - DNA, 20 bp, Homo Sapiens
  primer_bind 1..20: upstream amplification primer 99-21323 for SEQ 2973,
tacttagcaacatatcttgg

SEQ ID NO: 6908 - DNA, 18 bp, Homo Sapiens
  primer_bind 1..18: upstream amplification primer 99-21327 for SEQ 2974,
aactattgtcccactgtc

SEQ ID NO: 6909 - DNA, 21 bp, Homo Sapiens
  primer_bind 1..21: upstream amplification primer 99-21328 for SEQ 2975,
ccagggttaaaaaatactttc

SEQ ID NO: 6910 - DNA, 19 bp, Homo Sapiens
  primer_bind 1..19: upstream amplification primer 99-21329 for SEQ 2976,
ttagtaacagaggatatgg

SEQ ID NO: 6911 - DNA, 19 bp, Homo Sapiens
  primer_bind 1..19: upstream amplification primer 99-21342 for SEQ 2977,
tacttccactgctttagtc

SEQ ID NO: 6912 - DNA, 19 bp, Homo Sapiens
  primer_bind 1..19: upstream amplification primer 99-21346 for SEQ 2978,
agtggggaagatagatatg

SEQ ID NO: 6913 - DNA, 21 bp, Homo Sapiens
  primer_bind 1..21: upstream amplification primer 99-21360 for SEQ 2979,
gtttgctctttgcctcccaag

SEQ ID NO: 6914 - DNA, 19 bp, Homo Sapiens
  primer_bind 1..19: upstream amplification primer 99-21361 for SEQ 2980,
caaaaaccctttttacctc

SEQ ID NO: 6915 - DNA, 19 bp, Homo Sapiens
  primer_bind 1..19: upstream amplification primer 99-21377 for SEQ 2981,
gcatcccatgtaaaatgtc

SEQ ID NO: 6916 - DNA, 20 bp, Homo Sapiens
  primer_bind 1..20: upstream amplification primer 99-21378 for SEQ 2982,
tattttttctcactcacagg

SEQ ID NO: 6917 - DNA, 19 bp, Homo Sapiens
  primer_bind 1..19: upstream amplification primer 99-21391 for SEQ 2983,
tatttcatgtatcgtgagg

SEQ ID NO: 6918 - DNA, 20 bp, Homo Sapiens
  primer_bind 1..20: upstream amplification primer 99-21401 for SEQ 2984,
gatgtatagtctggagtgtc

SEQ ID NO: 6919 - DNA, 19 bp, Homo Sapiens
  primer_bind 1..19: upstream amplification primer 99-21423 for SEQ 2985,
caaagagaatgcttggttg

SEQ ID NO: 6920 - DNA, 19 bp, Homo Sapiens
  primer_bind 1..19: upstream amplification primer 99-21433 for SEQ 2986,
aggtgacaaagatcaaagc

SEQ ID NO: 6921 - DNA, 19 bp, Homo Sapiens
  primer_bind 1..19: upstream amplification primer 99-21441 for SEQ 2987,
ctttatccttatccccgtc

SEQ ID NO: 6922 - DNA, 18 bp, Homo Sapiens
  primer_bind 1..18: upstream amplification primer 99-21444 for SEQ 2988,
gaacattctgactgtgcc

SEQ ID NO: 6923 - DNA, 19 bp, Homo Sapiens
  primer_bind 1..19: upstream amplification primer 99-21448 for SEQ 2989,
agagtccctaacctcactg

SEQ ID NO: 6924 - DNA, 20 bp, Homo Sapiens
  primer_bind 1..20: upstream amplification primer 99-21461 for SEQ 2990,
gggtggaagttagtttaatc

SEQ ID NO: 6925 - DNA, 19 bp, Homo Sapiens
  primer_bind 1..19: upstream amplification primer 99-21463 for SEQ 2991,
gcctccattctaaatcaag

SEQ ID NO: 6926 - DNA, 20 bp, Homo Sapiens
  primer_bind 1..20: upstream amplification primer 99-21465 for SEQ 2992,
tccactgcctatcccaaacc

SEQ ID NO: 6927 - DNA, 20 bp, Homo Sapiens
  primer_bind 1..20: upstream amplification primer 99-21486 for SEQ 2993,
tctgtctgcccagaacatcc

SEQ ID NO: 6928 - DNA, 19 bp, Homo Sapiens
  primer_bind 1..19: upstream amplification primer 99-21492 for SEQ 2994,
ggaaatcagggatagagtg

SEQ ID NO: 6929 - DNA, 21 bp, Homo Sapiens
  primer_bind 1..21: upstream amplification primer 99-21502 for SEQ 2995,
caaagccagtgtcatagtatc

SEQ ID NO: 6930 - DNA, 21 bp, Homo Sapiens
  primer_bind 1..21: upstream amplification primer 99-21508 for SEQ 2996,
gaatttttttgggagatagag

SEQ ID NO: 6931 - DNA, 18 bp, Homo Sapiens
  primer_bind 1..18: upstream amplification primer 99-21510 for SEQ 2997,
agctaggactcctttttg

SEQ ID NO: 6932 - DNA, 20 bp, Homo Sapiens
  primer_bind 1..20: upstream amplification primer 99-21512 for SEQ 2998,
gtcaacattcttggacactc

SEQ ID NO: 6933 - DNA, 18 bp, Homo Sapiens
  primer_bind 1..18: upstream amplification primer 99-21516 for SEQ 2999,
tgtcatctgtaaactcgg

SEQ ID NO: 6934 - DNA, 19 bp, Homo Sapiens
  primer_bind 1..19: upstream amplification primer 99-21533 for SEQ 3000,
tattccaaacatcacctcc

SEQ ID NO: 6935 - DNA, 21 bp, Homo Sapiens
  primer_bind 1..21: upstream amplification primer 99-21560 for SEQ 3001,
catgatatggaagtcaataag

SEQ ID NO: 6936 - DNA, 19 bp, Homo Sapiens
  primer_bind 1..19: upstream amplification primer 99-21561 for SEQ 3002,
tttttgcccattcgtaaag

SEQ ID NO: 6937 - DNA, 20 bp, Homo Sapiens
  primer_bind 1..20: upstream amplification primer 99-21566 for SEQ 3003,
gtatgtatcaatgatgcctg

SEQ ID NO: 6938 - DNA, 20 bp, Homo Sapiens
  primer_bind 1..20: upstream amplification primer 99-21578 for SEQ 3004,
gaccaacaaggtaaacaaag

SEQ ID NO: 6939 - DNA, 19 bp, Homo Sapiens
  primer_bind 1..19: upstream amplification primer 99-21580 for SEQ 3005,
tttggaagagatttctgtg

SEQ ID NO: 6940 - DNA, 20 bp, Homo Sapiens
  primer_bind 1..20: upstream amplification primer 99-21591 for SEQ 3006,
catgcaaaccatttcccaag

SEQ ID NO: 6941 - DNA, 20 bp, Homo Sapiens
  primer_bind 1..20: upstream amplification primer 99-21592 for SEQ 3007,
atcaggctccatttacttgc

SEQ ID NO: 6942 - DNA, 20 bp, Homo Sapiens
  primer_bind 1..20: upstream amplification primer 99-21607 for SEQ 3008,
tcctggtcccactcattaac

SEQ ID NO: 6943 - DNA, 19 bp, Homo Sapiens
  primer_bind 1..19: upstream amplification primer 99-21615 for SEQ 3009,
ttaatagacagggaaacgg

SEQ ID NO: 6944 - DNA, 21 bp, Homo Sapiens
  primer_bind 1..21: upstream amplification primer 99-21657 for SEQ 3010,
catgctctggagacaatttac

SEQ ID NO: 6945 - DNA, 19 bp, Homo Sapiens
  primer_bind 1..19: upstream amplification primer 99-21664 for SEQ 3011,
gagaaagcaaatccgatac

SEQ ID NO: 6946 - DNA, 20 bp, Homo Sapiens
  primer_bind 1..20: upstream amplification primer 99-21666 for SEQ 3012,
aaagccttttgcctgctggg

SEQ ID NO: 6947 - DNA, 18 bp, Homo Sapiens
  primer_bind 1..18: upstream amplification primer 99-21673 for SEQ 3013,
cacatcgctccttagaac

SEQ ID NO: 6948 - DNA, 19 bp, Homo Sapiens
  primer_bind 1..19: upstream amplification primer 99-21674 for SEQ 3014,
tgaggacttttaaagagag

SEQ ID NO: 6949 - DNA, 20 bp, Homo Sapiens
  primer_bind 1..20: upstream amplification primer 99-21687 for SEQ 3015,
catacacataatggctctgg

SEQ ID NO: 6950 - DNA, 19 bp, Homo Sapiens
  primer_bind 1..19: upstream amplification primer 99-21690 for SEQ 3016,
gggatgtgatgaggtaaag

SEQ ID NO: 6951 - DNA, 19 bp, Homo Sapiens
  primer_bind 1..19: upstream amplification primer 99-21693 for SEQ 3017,
tggagttgggagttcatgg

SEQ ID NO: 6952 - DNA, 18 bp, Homo Sapiens
  primer_bind 1..18: upstream amplification primer 99-21699 for SEQ 3018,
aagacggtgtatgccaag

SEQ ID NO: 6953 - DNA, 18 bp, Homo Sapiens
  primer_bind 1..18: upstream amplification primer 99-21703 for SEQ 3019,
ggtcgaaagccttctatg

SEQ ID NO: 6954 - DNA, 20 bp, Homo Sapiens
  primer_bind 1..20: upstream amplification primer 99-21705 for SEQ 3020,
ggagagttgcctgatgaatc

SEQ ID NO: 6955 - DNA, 19 bp, Homo Sapiens
  primer_bind 1..19: upstream amplification primer 99-21707 for SEQ 3021,
ccttcattctaaaccttcc

SEQ ID NO: 6956 - DNA, 21 bp, Homo Sapiens
  primer_bind 1..21: upstream amplification primer 99-21710 for SEQ 3022,
cgtttcttttgagaatatgcc

SEQ ID NO: 6957 - DNA, 19 bp, Homo Sapiens
  primer_bind 1..19: upstream amplification primer 99-21733 for SEQ 3023,
tatgtatgctaacgtgttc

SEQ ID NO: 6958 - DNA, 20 bp, Homo Sapiens
  primer_bind 1..20: upstream amplification primer 99-21734 for SEQ 3024,
gtgaaaaagacttgaatggc

SEQ ID NO: 6959 - DNA, 19 bp, Homo Sapiens
  primer_bind 1..19: upstream amplification primer 99-21742 for SEQ 3025,
gaactatgtattggtatgg

SEQ ID NO: 6960 - DNA, 19 bp, Homo Sapiens
  primer_bind 1..19: upstream amplification primer 99-21745 for SEQ 3026,
ctatgtgttgctttgcttg

SEQ ID NO: 6961 - DNA, 21 bp, Homo Sapiens
  primer_bind 1..21: upstream amplification primer 99-21756 for SEQ 3027,
cacactgagttaaggttcaag

SEQ ID NO: 6962 - DNA, 18 bp, Homo Sapiens
  primer_bind 1..18: upstream amplification primer 99-21759 for SEQ 3028,
aacttctgctcggatttg

SEQ ID NO: 6963 - DNA, 19 bp, Homo Sapiens
  primer_bind 1..19: upstream amplification primer 99-21762 for SEQ 3029,
ttatgatggcattgcctac

SEQ ID NO: 6964 - DNA, 21 bp, Homo Sapiens
  primer_bind 1..21: upstream amplification primer 99-21763 for SEQ 3030,
ccttttcttcttctctgtctc

SEQ ID NO: 6965 - DNA, 19 bp, Homo Sapiens
  primer_bind 1..19: upstream amplification primer 99-21765 for SEQ 3031,
acccaaggaatttttagac

SEQ ID NO: 6966 - DNA, 20 bp, Homo Sapiens
  primer_bind 1..20: upstream amplification primer 99-21767 for SEQ 3032,
tcctcctagagggaccaaac

SEQ ID NO: 6967 - DNA, 18 bp, Homo Sapiens
  primer_bind 1..18: upstream amplification primer 99-21771 for SEQ 3033,
aagcatccactatctgtc

SEQ ID NO: 6968 - DNA, 19 bp, Homo Sapiens
  primer_bind 1..19: upstream amplification primer 99-21775 for SEQ 3034,
acaaatccttggcatcccc

SEQ ID NO: 6969 - DNA, 19 bp, Homo Sapiens
  primer_bind 1..19: upstream amplification primer 99-21787 for SEQ 3035,
ccttgaagctaatacgctg

SEQ ID NO: 6970 - DNA, 19 bp, Homo Sapiens
  primer_bind 1..19: upstream amplification primer 99-21790 for SEQ 3036,
atttagtgtcaagcacctc

SEQ ID NO: 6971 - DNA, 21 bp, Homo Sapiens
  primer_bind 1..21: upstream amplification primer 99-21791 for SEQ 3037,
ggtgtgttgacttaaatgagg

SEQ ID NO: 6972 - DNA, 20 bp, Homo Sapiens
  primer_bind 1..20: upstream amplification primer 99-21800 for SEQ 3038,
gtgaagtgaggggaaaaatg

SEQ ID NO: 6973 - DNA, 18 bp, Homo Sapiens
  primer_bind 1..18: upstream amplification primer 99-21801 for SEQ 3039,
ttgccctcacttacatcc

SEQ ID NO: 6974 - DNA, 21 bp, Homo Sapiens
  primer_bind 1..21: upstream amplification primer 99-21804 for SEQ 3040,
gagacagagtccagattttag

SEQ ID NO: 6975 - DNA, 18 bp, Homo Sapiens
  primer_bind 1..18: upstream amplification primer 99-21810 for SEQ 3041,
agcaggacaaatctgagc

SEQ ID NO: 6976 - DNA, 20 bp, Homo Sapiens
  primer_bind 1..20: upstream amplification primer 99-21811 for SEQ 3042,
gcaggaagtcattcattatg

SEQ ID NO: 6977 - DNA, 19 bp, Homo Sapiens
  primer_bind 1..19: upstream amplification primer 99-21827 for SEQ 3043,
gtgactcaatctaaaagcc

SEQ ID NO: 6978 - DNA, 18 bp, Homo Sapiens
  primer_bind 1..18: upstream amplification primer 99-21829 for SEQ 3044,
gacgacctctccaaaaag

SEQ ID NO: 6979 - DNA, 19 bp, Homo Sapiens
  primer_bind 1..19: upstream amplification primer 99-21831 for SEQ 3045,
ttcactttcagggagcagg

SEQ ID NO: 6980 - DNA, 18 bp, Homo Sapiens
  primer_bind 1..18: upstream amplification primer 99-21838 for SEQ 3046,
aaggaggtttccccaatc

SEQ ID NO: 6981 - DNA, 18 bp, Homo Sapiens
  primer_bind 1..18: upstream amplification primer 99-21844 for SEQ 3047,
ggatacaggaaacgtgag

SEQ ID NO: 6982 - DNA, 19 bp, Homo Sapiens
  primer_bind 1..19: upstream amplification primer 99-21846 for SEQ 3048,
gatttgttaatggggtagg

SEQ ID NO: 6983 - DNA, 21 bp, Homo Sapiens
  primer_bind 1..21: upstream amplification primer 99-21874 for SEQ 3049,
ctgtctctgttgacttaaagg

SEQ ID NO: 6984 - DNA, 19 bp, Homo Sapiens
  primer_bind 1..19: upstream amplification primer 99-21880 for SEQ 3050,
atcaccagtagacacctcc

SEQ ID NO: 6985 - DNA, 19 bp, Homo Sapiens
  primer_bind 1..19: upstream amplification primer 99-21881 for SEQ 3051,
aggctcatcttcacaaatc

SEQ ID NO: 6986 - DNA, 18 bp, Homo Sapiens
  primer_bind 1..18: upstream amplification primer 99-21889 for SEQ 3052,
tgacactggtattgtgac

SEQ ID NO: 6987 - DNA, 19 bp, Homo Sapiens
  primer_bind 1..19: upstream amplification primer 99-21893 for SEQ 3053,
aataatccagaactgacac

SEQ ID NO: 6988 - DNA, 18 bp, Homo Sapiens
  primer_bind 1..18: upstream amplification primer 99-21896 for SEQ 3054,
tgtcgtcatgtagaaggg

SEQ ID NO: 6989 - DNA, 21 bp, Homo Sapiens
  primer_bind 1..21: upstream amplification primer 99-21898 for SEQ 3055,
ctaaaatctttctaagtgacc

SEQ ID NO: 6990 - DNA, 19 bp, Homo Sapiens
  primer_bind 1..19: upstream amplification primer 99-21901 for SEQ 3056,
aactttgacccttcttgtg

SEQ ID NO: 6991 - DNA, 19 bp, Homo Sapiens
  primer_bind 1..19: upstream amplification primer 99-21913 for SEQ 3057,
gtgtgtgtaaagagataag

SEQ ID NO: 6992 - DNA, 18 bp, Homo Sapiens
  primer_bind 1..18: upstream amplification primer 99-21916 for SEQ 3058,
ttgtgcttgtcgctactg

SEQ ID NO: 6993 - DNA, 19 bp, Homo Sapiens
  primer_bind 1..19: upstream amplification primer 99-21917 for SEQ 3059,
gtctgtgtatgaacatagg

SEQ ID NO: 6994 - DNA, 19 bp, Homo Sapiens
  primer_bind 1..19: upstream amplification primer 99-21919 for SEQ 3060,
gccaaatctattcctatcc

SEQ ID NO: 6995 - DNA, 19 bp, Homo Sapiens
  primer_bind 1..19: upstream amplification primer 99-21921 for SEQ 3061,
tttggatggagatagatag

SEQ ID NO: 6996 - DNA, 21 bp, Homo Sapiens
  primer_bind 1..21: upstream amplification primer 99-21943 for SEQ 3062,
gtgttaaaaaacttgtcgctc

SEQ ID NO: 6997 - DNA, 19 bp, Homo Sapiens
  primer_bind 1..19: upstream amplification primer 99-21948 for SEQ 3063,
tacaacacccacccatacc

SEQ ID NO: 6998 - DNA, 19 bp, Homo Sapiens
  primer_bind 1..19: upstream amplification primer 99-21950 for SEQ 3064,
atattttgaaggtggagtg

SEQ ID NO: 6999 - DNA, 19 bp, Homo Sapiens
  primer_bind 1..19: upstream amplification primer 99-21952 for SEQ 3065,
gtttctgggcttatatctg

SEQ ID NO: 7000 - DNA, 21 bp, Homo Sapiens
  primer_bind 1..21: upstream amplification primer 99-21968 for SEQ 3066,
gctgcctgatggcattattac

SEQ ID NO: 7001 - DNA, 21 bp, Homo Sapiens
  primer_bind 1..21: upstream amplification primer 99-21969 for SEQ 3067,
gttaaaaaaaatgaggttccc

SEQ ID NO: 7002 - DNA, 18 bp, Homo Sapiens
  primer_bind 1..18: upstream amplification primer 99-22008 for SEQ 3068,
tggtctatgatgctactg

SEQ ID NO: 7003 - DNA, 18 bp, Homo Sapiens
  primer_bind 1..18: upstream amplification primer 99-22098 for SEQ 3069,
ccctaaaataagacccac

SEQ ID NO: 7004 - DNA, 18 bp, Homo Sapiens
  primer_bind 1..18: upstream amplification primer 99-22155 for SEQ 3070,
acctctagtcttcagtcc

SEQ ID NO: 7005 - DNA, 19 bp, Homo Sapiens
  primer_bind 1..19: upstream amplification primer 99-22181 for SEQ 3071,
tgttatacccaagatgatg

SEQ ID NO: 7006 - DNA, 19 bp, Homo Sapiens
  primer_bind 1..19: upstream amplification primer 99-22187 for SEQ 3072,
ttctcttagcacatactac

SEQ ID NO: 7007 - DNA, 19 bp, Homo Sapiens
  primer_bind 1..19: upstream amplification primer 99-22190 for SEQ 3073,
ctcagaatgaaacaaaagg

SEQ ID NO: 7008 - DNA, 18 bp, Homo Sapiens
  primer_bind 1..18: upstream amplification primer 99-22202 for SEQ 3074,
tgcttactcgtgaagaac

SEQ ID NO: 7009 - DNA, 18 bp, Homo Sapiens
  primer_bind 1..18: upstream amplification primer 99-22204 for SEQ 3075,
agatacttgagggaatgg

SEQ ID NO: 7010 - DNA, 21 bp, Homo Sapiens
  primer_bind 1..21: upstream amplification primer 99-22206 for SEQ 3076,
caaatgcttacatatagtagg

SEQ ID NO: 7011 - DNA, 19 bp, Homo Sapiens
  primer_bind 1..19: upstream amplification primer 99-22213 for SEQ 3077,
tgttgaaattttcctgcac

SEQ ID NO: 7012 - DNA, 18 bp, Homo Sapiens
  primer_bind 1..18: upstream amplification primer 99-22355 for SEQ 3078,
gggacaaatgtgtggtag

SEQ ID NO: 7013 - DNA, 19 bp, Homo Sapiens
  primer_bind 1..19: upstream amplification primer 99-22363 for SEQ 3079,
gggatttgtggttatagag

SEQ ID NO: 7014 - DNA, 19 bp, Homo Sapiens
  primer_bind 1..19: upstream amplification primer 99-22375 for SEQ 3080,
aagaaacagagacagaaag

SEQ ID NO: 7015 - DNA, 18 bp, Homo Sapiens
  primer_bind 1..18: upstream amplification primer 99-22405 for SEQ 3081,
aacaatttgctggctgtc

SEQ ID NO: 7016 - DNA, 18 bp, Homo Sapiens
  primer_bind 1..18: upstream amplification primer 99-2251 for SEQ 3082,
tatatgtagagggtgagg

SEQ ID NO: 7017 - DNA, 19 bp, Homo Sapiens
  primer_bind 1..19: upstream amplification primer 99-22530 for SEQ 3083,
cttttagtacctgattctg

SEQ ID NO: 7018 - DNA, 19 bp, Homo Sapiens
  primer_bind 1..19: upstream amplification primer 99-22537 for SEQ 3084,
cattaagtggctgttcatc

SEQ ID NO: 7019 - DNA, 18 bp, Homo Sapiens
  primer_bind 1..18: upstream amplification primer 99-22567 for SEQ 3085,
gtgagtgatgataactgg

SEQ ID NO: 7020 - DNA, 20 bp, Homo Sapiens
  primer_bind 1..20: upstream amplification primer 99-22572 for SEQ 3086,
gtttctgattatacacctcc

SEQ ID NO: 7021 - DNA, 18 bp, Homo Sapiens
  primer_bind 1..18: upstream amplification primer 99-22593 for SEQ 3087,
gattcggagtggaaagtc

SEQ ID NO: 7022 - DNA, 19 bp, Homo Sapiens
  primer_bind 1..19: upstream amplification primer 99-22706 for SEQ 3088,
aaagctatacatacaaggg

SEQ ID NO: 7023 - DNA, 20 bp, Homo Sapiens
  primer_bind 1..20: upstream amplification primer 99-22729 for SEQ 3089,
ttgctcaacggggacacatc

SEQ ID NO: 7024 - DNA, 18 bp, Homo Sapiens
  primer_bind 1..18: upstream amplification primer 99-22768 for SEQ 3090,
gagatgacagaaccaaag

SEQ ID NO: 7025 - DNA, 18 bp, Homo Sapiens
  primer_bind 1..18: upstream amplification primer 99-22814 for SEQ 3091,
gcttactcaacattgcac

SEQ ID NO: 7026 - DNA, 21 bp, Homo Sapiens
  primer_bind 1..21: upstream amplification primer 99-22818 for SEQ 3092,
gataagaaagtcaataggtag

SEQ ID NO: 7027 - DNA, 20 bp, Homo Sapiens
  primer_bind 1..20: upstream amplification primer 99-22826 for SEQ 3093,
caaatgaatagtgtaggcag

SEQ ID NO: 7028 - DNA, 18 bp, Homo Sapiens
  primer_bind 1..18: upstream amplification primer 99-22851 for SEQ 3094,
gtagacagccatagtgag

SEQ ID NO: 7029 - DNA, 18 bp, Homo Sapiens
  primer_bind 1..18: upstream amplification primer 99-23113 for SEQ 3095,
tgaggcatgaaaaggaag

SEQ ID NO: 7030 - DNA, 19 bp, Homo Sapiens
  primer_bind 1..19: upstream amplification primer 99-23188 for SEQ 3096,
tcagagggtccgaaatcag

SEQ ID NO: 7031 - DNA, 18 bp, Homo Sapiens
  primer_bind 1..18: upstream amplification primer 99-23240 for SEQ 3097,
cttctcaaatgctacccc

SEQ ID NO: 7032 - DNA, 19 bp, Homo Sapiens
  primer_bind 1..19: upstream amplification primer 99-23246 for SEQ 3098,
gcgtctctgttatatgagg

SEQ ID NO: 7033 - DNA, 18 bp, Homo Sapiens
  primer_bind 1..18: upstream amplification primer 99-23248 for SEQ 3099,
tcttctgcgtttcagctc

SEQ ID NO: 7034 - DNA, 19 bp, Homo Sapiens
  primer_bind 1..19: upstream amplification primer 99-23249 for SEQ 3100,
tgagggatttaatctgttc

SEQ ID NO: 7035 - DNA, 19 bp, Homo Sapiens
  primer_bind 1..19: upstream amplification primer 99-23274 for SEQ 3101,
ggcatcattaaactcttac

SEQ ID NO: 7036 - DNA, 21 bp, Homo Sapiens
  primer_bind 1..21: upstream amplification primer 99-2333 for SEQ 3102,
ccaggaataatactttgcatc

SEQ ID NO: 7037 - DNA, 19 bp, Homo Sapiens
  primer_bind 1..19: upstream amplification primer 99-2341 for SEQ 3103,
ctcagtttttctttccacc

SEQ ID NO: 7038 - DNA, 20 bp, Homo Sapiens
  primer_bind 1..20: upstream amplification primer 99-2342 for SEQ 3104,
gactcaggcacaacttttag

SEQ ID NO: 7039 - DNA, 18 bp, Homo Sapiens
  primer_bind 1..18: upstream amplification primer 99-23427 for SEQ 3105,
cttcctcatccataaacc

SEQ ID NO: 7040 - DNA, 20 bp, Homo Sapiens
  primer_bind 1..20: upstream amplification primer 99-23442 for SEQ 3106,
cttttgagtatagaaacccc

SEQ ID NO: 7041 - DNA, 19 bp, Homo Sapiens
  primer_bind 1..19: upstream amplification primer 99-23544 for SEQ 3107,
aaggagacttaccaaatag

SEQ ID NO: 7042 - DNA, 20 bp, Homo Sapiens
  primer_bind 1..20: upstream amplification primer 99-23549 for SEQ 3108,
gtacatggattttactagac

SEQ ID NO: 7043 - DNA, 20 bp, Homo Sapiens
  primer_bind 1..20: upstream amplification primer 99-23558 for SEQ 3109,
ccttaaagatactgctgctg

SEQ ID NO: 7044 - DNA, 20 bp, Homo Sapiens
  primer_bind 1..20: upstream amplification primer 99-23565 for SEQ 3110,
tatcccatccacagatcccc

SEQ ID NO: 7045 - DNA, 20 bp, Homo Sapiens
  primer_bind 1..20: upstream amplification primer 99-23589 for SEQ 3111,
gctattttcctccactctac

SEQ ID NO: 7046 - DNA, 20 bp, Homo Sapiens
  primer_bind 1..20: upstream amplification primer 99-23590 for SEQ 3112,
ctgactatgtggaccaggac

SEQ ID NO: 7047 - DNA, 19 bp, Homo Sapiens
  primer_bind 1..19: upstream amplification primer 99-23621 for SEQ 3113,
tctcttagtcggtacggtg

SEQ ID NO: 7048 - DNA, 19 bp, Homo Sapiens
  primer_bind 1..19: upstream amplification primer 99-23641 for SEQ 3114,
tgcgtatcaaccttgtaac

SEQ ID NO: 7049 - DNA, 20 bp, Homo Sapiens
  primer_bind 1..20: upstream amplification primer 99-23652 for SEQ 3115,
aagcctgatgcgaagagagc

SEQ ID NO: 7050 - DNA, 18 bp, Homo Sapiens
  primer_bind 1..18: upstream amplification primer 99-23696 for SEQ 3116,
ccctgttaccctcaaatc

SEQ ID NO: 7051 - DNA, 21 bp, Homo Sapiens
  primer_bind 1..21: upstream amplification primer 99-23701 for SEQ 3117,
aataacttaggaggttggagg

SEQ ID NO: 7052 - DNA, 20 bp, Homo Sapiens
  primer_bind 1..20: upstream amplification primer 99-23702 for SEQ 3118,
ggttacagagaaagaaagtc

SEQ ID NO: 7053 - DNA, 19 bp, Homo Sapiens
  primer_bind 1..19: upstream amplification primer 99-2371 for SEQ 3119,
gtactgtcaaatcatcacc

SEQ ID NO: 7054 - DNA, 20 bp, Homo Sapiens
  primer_bind 1..20: upstream amplification primer 99-23711 for SEQ 3120,
gtttggtatctggttttttg

SEQ ID NO: 7055 - DNA, 20 bp, Homo Sapiens
  primer_bind 1..20: upstream amplification primer 99-23730 for SEQ 3121,
cgtttttgaaagttttctcc

SEQ ID NO: 7056 - DNA, 21 bp, Homo Sapiens
  primer_bind 1..21: upstream amplification primer 99-23736 for SEQ 3122,
gagaaaataaactgttatggg

SEQ ID NO: 7057 - DNA, 19 bp, Homo Sapiens
  primer_bind 1..19: upstream amplification primer 99-23813 for SEQ 3123,
gatagaactttaagcactg

SEQ ID NO: 7058 - DNA, 21 bp, Homo Sapiens
  primer_bind 1..21: upstream amplification primer 99-23821 for SEQ 3124,
cataaagtagtgcctctcaac

SEQ ID NO: 7059 - DNA, 20 bp, Homo Sapiens
  primer_bind 1..20: upstream amplification primer 99-23844 for SEQ 3125,
tgcaggattgagcacggttg

SEQ ID NO: 7060 - DNA, 20 bp, Homo Sapiens
  primer_bind 1..20: upstream amplification primer 99-23858 for SEQ 3126,
caaatacgtgactaaaaagg

SEQ ID NO: 7061 - DNA, 21 bp, Homo Sapiens
  primer_bind 1..21: upstream amplification primer 99-23860 for SEQ 3127,
ctctttgcttagtatgttgcc

SEQ ID NO: 7062 - DNA, 21 bp, Homo Sapiens
  primer_bind 1..21: upstream amplification primer 99-23876 for SEQ 3128,
cctgaagagtcccagaagttc

SEQ ID NO: 7063 - DNA, 20 bp, Homo Sapiens
  primer_bind 1..20: upstream amplification primer 99-23878 for SEQ 3129,
cagattcctgagcagagcac

SEQ ID NO: 7064 - DNA, 20 bp, Homo Sapiens
  primer_bind 1..20: upstream amplification primer 99-23880 for SEQ 3130,
atactgggcactccttactc

SEQ ID NO: 7065 - DNA, 21 bp, Homo Sapiens
  primer_bind 1..21: upstream amplification primer 99-23887 for SEQ 3131,
cagcttgaagtcatctccttg

SEQ ID NO: 7066 - DNA, 19 bp, Homo Sapiens
  primer_bind 1..19: upstream amplification primer 99-23889 for SEQ 3132,
gtgaatgggaagcgttaag

SEQ ID NO: 7067 - DNA, 20 bp, Homo Sapiens
  primer_bind 1..20: upstream amplification primer 99-23894 for SEQ 3133,
ggcttcactaagaaaatgag

SEQ ID NO: 7068 - DNA, 21 bp, Homo Sapiens
  primer_bind 1..21: upstream amplification primer 99-23895 for SEQ 3134,
aaagtaaccttgtagctggtg

SEQ ID NO: 7069 - DNA, 21 bp, Homo Sapiens
  primer_bind 1..21: upstream amplification primer 99-23902 for SEQ 3135,
ttcttgggcatcgttttcctc

SEQ ID NO: 7070 - DNA, 20 bp, Homo Sapiens
  primer_bind 1..20: upstream amplification primer 99-23912 for SEQ 3136,
gtgactctcatttctgtctc

SEQ ID NO: 7071 - DNA, 19 bp, Homo Sapiens
  primer_bind 1..19: upstream amplification primer 99-23915 for SEQ 3137,
tgcttgatcgaagagccac

SEQ ID NO: 7072 - DNA, 20 bp, Homo Sapiens
  primer_bind 1..20: upstream amplification primer 99-23918 for SEQ 3138,
tctttggtggtggaggtctg

SEQ ID NO: 7073 - DNA, 21 bp, Homo Sapiens
  primer_bind 1..21: upstream amplification primer 99-23934 for SEQ 3139,
gacattgaaaagcaagtgatg

SEQ ID NO: 7074 - DNA, 21 bp, Homo Sapiens
  primer_bind 1..21: upstream amplification primer 99-23936 for SEQ 3140,
ctattgttctttgttcaaagg

SEQ ID NO: 7075 - DNA, 18 bp, Homo Sapiens
  primer_bind 1..18: upstream amplification primer 99-23938 for SEQ 3141,
gcaccgcatttttgtatc

SEQ ID NO: 7076 - DNA, 20 bp, Homo Sapiens
  primer_bind 1..20: upstream amplification primer 99-23943 for SEQ 3142,
gtcctgcattacataagtag

SEQ ID NO: 7077 - DNA, 20 bp, Homo Sapiens
  primer_bind 1..20: upstream amplification primer 99-23960 for SEQ 3143,
catcacagacaaccatttac

SEQ ID NO: 7078 - DNA, 21 bp, Homo Sapiens
  primer_bind 1..21: upstream amplification primer 99-23965 for SEQ 3144,
aagtgatggggtgggaaaaag

SEQ ID NO: 7079 - DNA, 20 bp, Homo Sapiens
  primer_bind 1..20: upstream amplification primer 99-23977 for SEQ 3145,
caatgtgtaactaatgcacc

SEQ ID NO: 7080 - DNA, 21 bp, Homo Sapiens
  primer_bind 1..21: upstream amplification primer 99-23987 for SEQ 3146,
aaaaaggagggagtaattggg

SEQ ID NO: 7081 - DNA, 19 bp, Homo Sapiens
  primer_bind 1..19: upstream amplification primer 99-23988 for SEQ 3147,
cttggctatccctacattc

SEQ ID NO: 7082 - DNA, 19 bp, Homo Sapiens
  primer_bind 1..19: upstream amplification primer 99-23995 for SEQ 3148,
ctagtaacacaaatgtggg

SEQ ID NO: 7083 - DNA, 21 bp, Homo Sapiens
  primer_bind 1..21: upstream amplification primer 99-24000 for SEQ 3149,
caccctcattatccccctaac

SEQ ID NO: 7084 - DNA, 20 bp, Homo Sapiens
  primer_bind 1..20: upstream amplification primer 99-24003 for SEQ 3150,
ctaggagttagggatgaaac

SEQ ID NO: 7085 - DNA, 21 bp, Homo Sapiens
  primer_bind 1..21: upstream amplification primer 99-24004 for SEQ 3151,
tttcatacctctctttccttc

SEQ ID NO: 7086 - DNA, 20 bp, Homo Sapiens
  primer_bind 1..20: upstream amplification primer 99-24007 for SEQ 3152,
ctgggagtgagtgaaaaaag

SEQ ID NO: 7087 - DNA, 20 bp, Homo Sapiens
  primer_bind 1..20: upstream amplification primer 99-24020 for SEQ 3153,
cagtggaggtacagaataag

SEQ ID NO: 7088 - DNA, 20 bp, Homo Sapiens
  primer_bind 1..20: upstream amplification primer 99-24038 for SEQ 3154,
tcctgcatctgcacacagag

SEQ ID NO: 7089 - DNA, 20 bp, Homo Sapiens
  primer_bind 1..20: upstream amplification primer 99-24063 for SEQ 3155,
tctcccgtctgtcgtttgtc

SEQ ID NO: 7090 - DNA, 20 bp, Homo Sapiens
  primer_bind 1..20: upstream amplification primer 99-24073 for SEQ 3156,
acgaagcaggaacagagtgg

SEQ ID NO: 7091 - DNA, 20 bp, Homo Sapiens
  primer_bind 1..20: upstream amplification primer 99-24075 for SEQ 3157,
agaattgggggttccctctg

SEQ ID NO: 7092 - DNA, 20 bp, Homo Sapiens
  primer_bind 1..20: upstream amplification primer 99-24079 for SEQ 3158,
ctgcatatcaatcagcagtg

SEQ ID NO: 7093 - DNA, 19 bp, Homo Sapiens
  primer_bind 1..19: upstream amplification primer 99-24084 for SEQ 3159,
cttagattggggacacttc

SEQ ID NO: 7094 - DNA, 18 bp, Homo Sapiens
  primer_bind 1..18: upstream amplification primer 99-24092 for SEQ 3160,
agtgctaactcggctggc

SEQ ID NO: 7095 - DNA, 21 bp, Homo Sapiens
  primer_bind 1..21: upstream amplification primer 99-24096 for SEQ 3161,
atgtttcccaggatcaaggag

SEQ ID NO: 7096 - DNA, 20 bp, Homo Sapiens
  primer_bind 1..20: upstream amplification primer 99-24105 for SEQ 3162,
tagattgggagggcatccag

SEQ ID NO: 7097 - DNA, 21 bp, Homo Sapiens
  primer_bind 1..21: upstream amplification primer 99-24113 for SEQ 3163,
gatgacatgatgaagaaaaac

SEQ ID NO: 7098 - DNA, 21 bp, Homo Sapiens
  primer_bind 1..21: upstream amplification primer 99-24117 for SEQ 3164,
cataacactgggtttctatgg

SEQ ID NO: 7099 - DNA, 21 bp, Homo Sapiens
  primer_bind 1..21: upstream amplification primer 99-24119 for SEQ 3165,
tgcatactgtgtataagggtc

SEQ ID NO: 7100 - DNA, 20 bp, Homo Sapiens
  primer_bind 1..20: upstream amplification primer 99-24123 for SEQ 3166,
aatttttgtgtagtcagtgg

SEQ ID NO: 7101 - DNA, 20 bp, Homo Sapiens
  primer_bind 1..20: upstream amplification primer 99-24140 for SEQ 3167,
tggagaactgctcacctctg

SEQ ID NO: 7102 - DNA, 21 bp, Homo Sapiens
  primer_bind 1..21: upstream amplification primer 99-24148 for SEQ 3168,
gcaagcaaaattggaaacaac

SEQ ID NO: 7103 - DNA, 21 bp, Homo Sapiens
  primer_bind 1..21: upstream amplification primer 99-24152 for SEQ 3169,
gccattctctttagaggatac

SEQ ID NO: 7104 - DNA, 19 bp, Homo Sapiens
  primer_bind 1..19: upstream amplification primer 99-24155 for SEQ 3170,
tcccacaacaggctctttg

SEQ ID NO: 7105 - DNA, 20 bp, Homo Sapiens
  primer_bind 1..20: upstream amplification primer 99-24156 for SEQ 3171,
tgttggttcaaccaccccag

SEQ ID NO: 7106 - DNA, 20 bp, Homo Sapiens
  primer_bind 1..20: upstream amplification primer 99-24167 for SEQ 3172,
ccaggtgcttatacattgac

SEQ ID NO: 7107 - DNA, 19 bp, Homo Sapiens
  primer_bind 1..19: upstream amplification primer 99-24175 for SEQ 3173,
tattagatggggagacgac

SEQ ID NO: 7108 - DNA, 19 bp, Homo Sapiens
  primer_bind 1..19: upstream amplification primer 99-24180 for SEQ 3174,
agttgaggggtttcagtgg

SEQ ID NO: 7109 - DNA, 21 bp, Homo Sapiens
  primer_bind 1..21: upstream amplification primer 99-24182 for SEQ 3175,
ctggtaaacagattctaaatg

SEQ ID NO: 7110 - DNA, 19 bp, Homo Sapiens
  primer_bind 1..19: upstream amplification primer 99-24185 for SEQ 3176,
cgaagtgttagacaccaag

SEQ ID NO: 7111 - DNA, 21 bp, Homo Sapiens
  primer_bind 1..21: upstream amplification primer 99-24187 for SEQ 3177,
cacaatttataggagtgttac

SEQ ID NO: 7112 - DNA, 19 bp, Homo Sapiens
  primer_bind 1..19: upstream amplification primer 99-24190 for SEQ 3178,
tcaagggagtctcctccac

SEQ ID NO: 7113 - DNA, 20 bp, Homo Sapiens
  primer_bind 1..20: upstream amplification primer 99-24202 for SEQ 3179,
caaaataagaatgactgctg

SEQ ID NO: 7114 - DNA, 21 bp, Homo Sapiens
  primer_bind 1..21: upstream amplification primer 99-24204 for SEQ 3180,
cttttccattcatccttctcc

SEQ ID NO: 7115 - DNA, 20 bp, Homo Sapiens
  primer_bind 1..20: upstream amplification primer 99-24208 for SEQ 3181,
gctctcaaacagttctcagg

SEQ ID NO: 7116 - DNA, 20 bp, Homo Sapiens
  primer_bind 1..20: upstream amplification primer 99-24210 for SEQ 3182,
cccctaccattctcaatttc

SEQ ID NO: 7117 - DNA, 20 bp, Homo Sapiens
  primer_bind 1..20: upstream amplification primer 99-24217 for SEQ 3183,
atagggtgagccgcatgaac

SEQ ID NO: 7118 - DNA, 19 bp, Homo Sapiens
  primer_bind 1..19: upstream amplification primer 99-24225 for SEQ 3184,
aatctgtgtggcaagggtc

SEQ ID NO: 7119 - DNA, 21 bp, Homo Sapiens
  primer_bind 1..21: upstream amplification primer 99-24228 for SEQ 3185,
ctgtttatctctccatagctc

SEQ ID NO: 7120 - DNA, 19 bp, Homo Sapiens
  primer_bind 1..19: upstream amplification primer 99-24232 for SEQ 3186,
tgagacgcagaggtgtaag

SEQ ID NO: 7121 - DNA, 21 bp, Homo Sapiens
  primer_bind 1..21: upstream amplification primer 99-24234 for SEQ 3187,
ttttaagaaacctgtgtcgcc

SEQ ID NO: 7122 - DNA, 18 bp, Homo Sapiens
  primer_bind 1..18: upstream amplification primer 99-24369 for SEQ 3188,
ttataccttccctatccc

SEQ ID NO: 7123 - DNA, 21 bp, Homo Sapiens
  primer_bind 1..21: upstream amplification primer 99-24397 for SEQ 3189,
ctctatttcttcaactttctc

SEQ ID NO: 7124 - DNA, 18 bp, Homo Sapiens
  primer_bind 1..18: upstream amplification primer 99-24408 for SEQ 3190,
aggagttacatggaagag

SEQ ID NO: 7125 - DNA, 19 bp, Homo Sapiens
  primer_bind 1..19: upstream amplification primer 99-2441 for SEQ 3191,
tacctgccttgcttctgtc

SEQ ID NO: 7126 - DNA, 19 bp, Homo Sapiens
  primer_bind 1..19: upstream amplification primer 99-24412 for SEQ 3192,
aggaaaactgcatcactgg

SEQ ID NO: 7127 - DNA, 18 bp, Homo Sapiens
  primer_bind 1..18: upstream amplification primer 99-24415 for SEQ 3193,
gacaactttctacacctg

SEQ ID NO: 7128 - DNA, 18 bp, Homo Sapiens
  primer_bind 1..18: upstream amplification primer 99-24470 for SEQ 3194,
caattagaacacacggtc

SEQ ID NO: 7129 - DNA, 19 bp, Homo Sapiens
  primer_bind 1..19: upstream amplification primer 99-24472 for SEQ 3195,
tttcttaggagatgacttg

SEQ ID NO: 7130 - DNA, 19 bp, Homo Sapiens
  primer_bind 1..19: upstream amplification primer 99-24480 for SEQ 3196,
acagcagcagagtcagtag

SEQ ID NO: 7131 - DNA, 19 bp, Homo Sapiens
  primer_bind 1..19: upstream amplification primer 99-24485 for SEQ 3197,
ataactggatttgactctg

SEQ ID NO: 7132 - DNA, 19 bp, Homo Sapiens
  primer_bind 1..19: upstream amplification primer 99-24490 for SEQ 3198,
gaggaaagaaaattagggg

SEQ ID NO: 7133 - DNA, 18 bp, Homo Sapiens
  primer_bind 1..18: upstream amplification primer 99-24492 for SEQ 3199,
tccatctctgctacttac

SEQ ID NO: 7134 - DNA, 19 bp, Homo Sapiens
  primer_bind 1..19: upstream amplification primer 99-24581 for SEQ 3200,
ggttagggaataaatactg

SEQ ID NO: 7135 - DNA, 18 bp, Homo Sapiens
  primer_bind 1..18: upstream amplification primer 99-24591 for SEQ 3201,
ctccatgtctactttctc

SEQ ID NO: 7136 - DNA, 19 bp, Homo Sapiens
  primer_bind 1..19: upstream amplification primer 99-24592 for SEQ 3202,
tctgttgggtaataaatgg

SEQ ID NO: 7137 - DNA, 19 bp, Homo Sapiens
  primer_bind 1..19: upstream amplification primer 99-24745 for SEQ 3203,
atgcacaaacacaaaaccc

SEQ ID NO: 7138 - DNA, 20 bp, Homo Sapiens
  primer_bind 1..20: upstream amplification primer 99-24753 for SEQ 3204,
caagaaaaaaagccacacag

SEQ ID NO: 7139 - DNA, 19 bp, Homo Sapiens
  primer_bind 1..19: upstream amplification primer 99-24768 for SEQ 3205,
gagaaagcaagaaagagag

SEQ ID NO: 7140 - DNA, 20 bp, Homo Sapiens
  primer_bind 1..20: upstream amplification primer 99-24855 for SEQ 3206,
ctttataacctgactccaac

SEQ ID NO: 7141 - DNA, 21 bp, Homo Sapiens
  primer_bind 1..21: upstream amplification primer 99-24863 for SEQ 3207,
ggcagggaaatacataattgg

SEQ ID NO: 7142 - DNA, 20 bp, Homo Sapiens
  primer_bind 1..20: upstream amplification primer 99-24867 for SEQ 3208,
cacctaagatcagttttacc

SEQ ID NO: 7143 - DNA, 18 bp, Homo Sapiens
  primer_bind 1..18: upstream amplification primer 99-24871 for SEQ 3209,
aggtcttagggtgttgtc

SEQ ID NO: 7144 - DNA, 18 bp, Homo Sapiens
  primer_bind 1..18: upstream amplification primer 99-24889 for SEQ 3210,
ctgtgttgttggtcatgg

SEQ ID NO: 7145 - DNA, 20 bp, Homo Sapiens
  primer_bind 1..20: upstream amplification primer 99-24897 for SEQ 3211,
agagtggagaatggggagag

SEQ ID NO: 7146 - DNA, 20 bp, Homo Sapiens
  primer_bind 1..20: upstream amplification primer 99-24904 for SEQ 3212,
gttgccatttaagtattagc

SEQ ID NO: 7147 - DNA, 18 bp, Homo Sapiens
  primer_bind 1..18: upstream amplification primer 99-24909 for SEQ 3213,
tgcaggtctgtaggttac

SEQ ID NO: 7148 - DNA, 21 bp, Homo Sapiens
  primer_bind 1..21: upstream amplification primer 99-24917 for SEQ 3214,
ggggaagaagaagatgatgac

SEQ ID NO: 7149 - DNA, 19 bp, Homo Sapiens
  primer_bind 1..19: upstream amplification primer 99-24930 for SEQ 3215,
aacaccaatatgaaaggac

SEQ ID NO: 7150 - DNA, 21 bp, Homo Sapiens
  primer_bind 1..21: upstream amplification primer 99-24936 for SEQ 3216,
gcaatttgtaatccattcaag

SEQ ID NO: 7151 - DNA, 19 bp, Homo Sapiens
  primer_bind 1..19: upstream amplification primer 99-24965 for SEQ 3217,
ggtggatgggtagattgag

SEQ ID NO: 7152 - DNA, 20 bp, Homo Sapiens
  primer_bind 1..20: upstream amplification primer 99-24966 for SEQ 3218,
aggaaccccctgaacttctg

SEQ ID NO: 7153 - DNA, 19 bp, Homo Sapiens
  primer_bind 1..19: upstream amplification primer 99-25020 for SEQ 3219,
ttaccaacctctggcgtag

SEQ ID NO: 7154 - DNA, 19 bp, Homo Sapiens
  primer_bind 1..19: upstream amplification primer 99-25362 for SEQ 3220,
ataacaaaaggtgctgttc

SEQ ID NO: 7155 - DNA, 18 bp, Homo Sapiens
  primer_bind 1..18: upstream amplification primer 99-25394 for SEQ 3221,
ttggaggatgttggtttg

SEQ ID NO: 7156 - DNA, 18 bp, Homo Sapiens
  primer_bind 1..18: upstream amplification primer 99-25406 for SEQ 3222,
atgcctctaaactctgcc

SEQ ID NO: 7157 - DNA, 19 bp, Homo Sapiens
  primer_bind 1..19: upstream amplification primer 99-25446 for SEQ 3223,
agtttggggtgttcagagg

SEQ ID NO: 7158 - DNA, 21 bp, Homo Sapiens
  primer_bind 1..21: upstream amplification primer 99-25496 for SEQ 3224,
gattattgtggcttttctttg

SEQ ID NO: 7159 - DNA, 19 bp, Homo Sapiens
  primer_bind 1..19: upstream amplification primer 99-25497 for SEQ 3225,
taacattgtgagaagatgg

SEQ ID NO: 7160 - DNA, 18 bp, Homo Sapiens
  primer_bind 1..18: upstream amplification primer 99-2559 for SEQ 3226,
gcatatcttggtggtctg

SEQ ID NO: 7161 - DNA, 20 bp, Homo Sapiens
  primer_bind 1..20: upstream amplification primer 99-25654 for SEQ 3227,
caaaaacccaacaaaagcag

SEQ ID NO: 7162 - DNA, 19 bp, Homo Sapiens
  primer_bind 1..19: upstream amplification primer 99-2566 for SEQ 3228,
agggttcaaaggaaggagg

SEQ ID NO: 7163 - DNA, 20 bp, Homo Sapiens
  primer_bind 1..20: upstream amplification primer 99-2567 for SEQ 3229,
gaaaaagaagggaaagaaag

SEQ ID NO: 7164 - DNA, 18 bp, Homo Sapiens
  primer_bind 1..18: upstream amplification primer 99-2571 for SEQ 3230,
tgaaaaagtgggtagcag

SEQ ID NO: 7165 - DNA, 21 bp, Homo Sapiens
  primer_bind 1..21: upstream amplification primer 99-25738 for SEQ 3231,
gttttggagtttgaatttctg

SEQ ID NO: 7166 - DNA, 18 bp, Homo Sapiens
  primer_bind 1..18: upstream amplification primer 99-25755 for SEQ 3232,
aatatgaagccaggtgag

SEQ ID NO: 7167 - DNA, 19 bp, Homo Sapiens
  primer_bind 1..19: upstream amplification primer 99-25834 for SEQ 3233,
gattaagctgtctctggtg

SEQ ID NO: 7168 - DNA, 21 bp, Homo Sapiens
  primer_bind 1..21: upstream amplification primer 99-25843 for SEQ 3234,
ctcttagagcattttatcagg

SEQ ID NO: 7169 - DNA, 20 bp, Homo Sapiens
  primer_bind 1..20: upstream amplification primer 99-26051 for SEQ 3235,
ggataaaaaagattagtggg

SEQ ID NO: 7170 - DNA, 19 bp, Homo Sapiens
  primer_bind 1..19: upstream amplification primer 99-26058 for SEQ 3236,
ttatgtgcctctgccttcc

SEQ ID NO: 7171 - DNA, 18 bp, Homo Sapiens
  primer_bind 1..18: upstream amplification primer 99-26074 for SEQ 3237,
taaccaatcgagggaaag

SEQ ID NO: 7172 - DNA, 19 bp, Homo Sapiens
  primer_bind 1..19: upstream amplification primer 99-26076 for SEQ 3238,
gtagaagggatgaattatg

SEQ ID NO: 7173 - DNA, 19 bp, Homo Sapiens
  primer_bind 1..19: upstream amplification primer 99-2630 for SEQ 3239,
atgtaacagatgtccaaag

SEQ ID NO: 7174 - DNA, 18 bp, Homo Sapiens
  primer_bind 1..18: upstream amplification primer 99-2633 for SEQ 3240,
ctaagggtcttctttctg

SEQ ID NO: 7175 - DNA, 19 bp, Homo Sapiens
  primer_bind 1..19: upstream amplification primer 99-2634 for SEQ 3241,
ggtgtatttaggtttgtgg

SEQ ID NO: 7176 - DNA, 18 bp, Homo Sapiens
  primer_bind 1..18: upstream amplification primer 99-2636 for SEQ 3242,
aatgagcaggagggacag

SEQ ID NO: 7177 - DNA, 18 bp, Homo Sapiens
  primer_bind 1..18: upstream amplification primer 99-2642 for SEQ 3243,
ataactaggcatccagac

SEQ ID NO: 7178 - DNA, 20 bp, Homo Sapiens
  primer_bind 1..20: upstream amplification primer 99-2645 for SEQ 3244,
cgacataatttggtatgtag

SEQ ID NO: 7179 - DNA, 18 bp, Homo Sapiens
  primer_bind 1..18: upstream amplification primer 99-2647 for SEQ 3245,
tcaccaagtgtcatcgtc

SEQ ID NO: 7180 - DNA, 19 bp, Homo Sapiens
  primer_bind 1..19: upstream amplification primer 99-2649 for SEQ 3246,
gagactttgtaactttgtg

SEQ ID NO: 7181 - DNA, 19 bp, Homo Sapiens
  primer_bind 1..19: upstream amplification primer 99-2711 for SEQ 3247,
tcatatacattctgagtcc

SEQ ID NO: 7182 - DNA, 18 bp, Homo Sapiens
  primer_bind 1..18: upstream amplification primer 99-2712 for SEQ 3248,
tttgagccaacagagacc

SEQ ID NO: 7183 - DNA, 21 bp, Homo Sapiens
  primer_bind 1..21: upstream amplification primer 99-2718 for SEQ 3249,
cattttcttgggcttgatagg

SEQ ID NO: 7184 - DNA, 18 bp, Homo Sapiens
  primer_bind 1..18: upstream amplification primer 99-2719 for SEQ 3250,
ttagagggagaaagggag

SEQ ID NO: 7185 - DNA, 18 bp, Homo Sapiens
  primer_bind 1..18: upstream amplification primer 99-2726 for SEQ 3251,
cttcgatctcctcttctg

SEQ ID NO: 7186 - DNA, 20 bp, Homo Sapiens
  primer_bind 1..20: upstream amplification primer 99-2734 for SEQ 3252,
ccaataatagcatcaggaag

SEQ ID NO: 7187 - DNA, 20 bp, Homo Sapiens
  primer_bind 1..20: upstream amplification primer 99-2740 for SEQ 3253,
gggaatacatataattgcag

SEQ ID NO: 7188 - DNA, 19 bp, Homo Sapiens
  primer_bind 1..19: upstream amplification primer 99-2752 for SEQ 3254,
ctgaggaatgatggaatgg

SEQ ID NO: 7189 - DNA, 18 bp, Homo Sapiens
  primer_bind 1..18: upstream amplification primer 99-2760 for SEQ 3255,
agccaaagaaggaaacag

SEQ ID NO: 7190 - DNA, 18 bp, Homo Sapiens
  primer_bind 1..18: upstream amplification primer 99-2761 for SEQ 3256,
actttggcttggcttatg

SEQ ID NO: 7191 - DNA, 18 bp, Homo Sapiens
  primer_bind 1..18: upstream amplification primer 99-2765 for SEQ 3257,
aacactctcaacctcctc

SEQ ID NO: 7192 - DNA, 19 bp, Homo Sapiens
  primer_bind 1..19: upstream amplification primer 99-2790 for SEQ 3258,
caggcaagacgaataatac

SEQ ID NO: 7193 - DNA, 20 bp, Homo Sapiens
  primer_bind 1..20: upstream amplification primer 99-2797 for SEQ 3259,
ggtattgtgtagatgtcagg

SEQ ID NO: 7194 - DNA, 18 bp, Homo Sapiens
  primer_bind 1..18: upstream amplification primer 99-2816 for SEQ 3260,
ggataaaatcacccccag

SEQ ID NO: 7195 - DNA, 18 bp, Homo Sapiens
  primer_bind 1..18: upstream amplification primer 99-2817 for SEQ 3261,
aatgtcctctccacactc

SEQ ID NO: 7196 - DNA, 19 bp, Homo Sapiens
  primer_bind 1..19: upstream amplification primer 99-2819 for SEQ 3262,
aactgtggactgagaggtg

SEQ ID NO: 7197 - DNA, 18 bp, Homo Sapiens
  primer_bind 1..18: upstream amplification primer 99-2820 for SEQ 3263,
attcccaaacctttcccc

SEQ ID NO: 7198 - DNA, 18 bp, Homo Sapiens
  primer_bind 1..18: upstream amplification primer 99-2832 for SEQ 3264,
caaaaacagtcagcagag

SEQ ID NO: 7199 - DNA, 19 bp, Homo Sapiens
  primer_bind 1..19: upstream amplification primer 99-2868 for SEQ 3265,
ccttgcttgtcttggtttg

SEQ ID NO: 7200 - DNA, 18 bp, Homo Sapiens
  primer_bind 1..18: upstream amplification primer 99-2870 for SEQ 3266,
ttcactctctacctcttc

SEQ ID NO: 7201 - DNA, 19 bp, Homo Sapiens
  primer_bind 1..19: upstream amplification primer 99-2881 for SEQ 3267,
ctacataatactgggttgg

SEQ ID NO: 7202 - DNA, 19 bp, Homo Sapiens
  primer_bind 1..19: upstream amplification primer 99-2895 for SEQ 3268,
ccatcattgattctcccac

SEQ ID NO: 7203 - DNA, 19 bp, Homo Sapiens
  primer_bind 1..19: upstream amplification primer 99-2903 for SEQ 3269,
agaagtggagaaaaagtag

SEQ ID NO: 7204 - DNA, 18 bp, Homo Sapiens
  primer_bind 1..18: upstream amplification primer 99-2906 for SEQ 3270,
tgtaggcttggttagcac

SEQ ID NO: 7205 - DNA, 19 bp, Homo Sapiens
  primer_bind 1..19: upstream amplification primer 99-2914 for SEQ 3271,
ggaattttggtagagattg

SEQ ID NO: 7206 - DNA, 19 bp, Homo Sapiens
  primer_bind 1..19: upstream amplification primer 99-2922 for SEQ 3272,
aaaaatgaaagggagaagg

SEQ ID NO: 7207 - DNA, 19 bp, Homo Sapiens
  primer_bind 1..19: upstream amplification primer 99-2924 for SEQ 3273,
gaaaagataagccacagag

SEQ ID NO: 7208 - DNA, 18 bp, Homo Sapiens
  primer_bind 1..18: upstream amplification primer 99-2926 for SEQ 3274,
attactaacaaccagccc

SEQ ID NO: 7209 - DNA, 20 bp, Homo Sapiens
  primer_bind 1..20: upstream amplification primer 99-2928 for SEQ 3275,
ggctcctaatctcaataatc

SEQ ID NO: 7210 - DNA, 21 bp, Homo Sapiens
  primer_bind 1..21: upstream amplification primer 99-2938 for SEQ 3276,
cagtgaagtcagttctcttgg

SEQ ID NO: 7211 - DNA, 19 bp, Homo Sapiens
  primer_bind 1..19: upstream amplification primer 99-2943 for SEQ 3277,
tatacacctgacttcatcg

SEQ ID NO: 7212 - DNA, 19 bp, Homo Sapiens
  primer_bind 1..19: upstream amplification primer 99-2944 for SEQ 3278,
aaaagtatcattggagctg

SEQ ID NO: 7213 - DNA, 18 bp, Homo Sapiens
  primer_bind 1..18: upstream amplification primer 99-295 for SEQ 3279,
gtgttgtgaatgaagtgg

SEQ ID NO: 7214 - DNA, 18 bp, Homo Sapiens
  primer_bind 1..18: upstream amplification primer 99-2954 for SEQ 3280,
gctcagttatcgaacacc

SEQ ID NO: 7215 - DNA, 18 bp, Homo Sapiens
  primer_bind 1..18: upstream amplification primer 99-2956 for SEQ 3281,
ctcagtttctctctctgg

SEQ ID NO: 7216 - DNA, 19 bp, Homo Sapiens
  primer_bind 1..19: upstream amplification primer 99-2970 for SEQ 3282,
ttccctcttttctctcccc

SEQ ID NO: 7217 - DNA, 18 bp, Homo Sapiens
  primer_bind 1..18: upstream amplification primer 99-2978 for SEQ 3283,
gtgcttgctttgatgatg

SEQ ID NO: 7218 - DNA, 21 bp, Homo Sapiens
  primer_bind 1..21: upstream amplification primer 99-2981 for SEQ 3284,
ctttcatattctttgtactcc

SEQ ID NO: 7219 - DNA, 20 bp, Homo Sapiens
  primer_bind 1..20: upstream amplification primer 99-2988 for SEQ 3285,
aggcatctgaaaatacacac

SEQ ID NO: 7220 - DNA, 20 bp, Homo Sapiens
  primer_bind 1..20: upstream amplification primer 99-2989 for SEQ 3286,
ggcgtattaattatccatgc

SEQ ID NO: 7221 - DNA, 19 bp, Homo Sapiens
  primer_bind 1..19: upstream amplification primer 99-2991 for SEQ 3287,
tatccagtaatgtaaaccc

SEQ ID NO: 7222 - DNA, 21 bp, Homo Sapiens
  primer_bind 1..21: upstream amplification primer 99-2995 for SEQ 3288,
cacttgacaggtatattatag

SEQ ID NO: 7223 - DNA, 20 bp, Homo Sapiens
  primer_bind 1..20: upstream amplification primer 99-2999 for SEQ 3289,
ggagatagttaaggaattag

SEQ ID NO: 7224 - DNA, 19 bp, Homo Sapiens
  primer_bind 1..19: upstream amplification primer 99-3013 for SEQ 3290,
tatgctcatgcagccttcc

SEQ ID NO: 7225 - DNA, 19 bp, Homo Sapiens
  primer_bind 1..19: upstream amplification primer 99-3018 for SEQ 3291,
cagggtctgtctcatattg

SEQ ID NO: 7226 - DNA, 19 bp, Homo Sapiens
  primer_bind 1..19: upstream amplification primer 99-3019 for SEQ 3292,
gatttgtctcatggactac

SEQ ID NO: 7227 - DNA, 19 bp, Homo Sapiens
  primer_bind 1..19: upstream amplification primer 99-3020 for SEQ 3293,
gaccttaaatgaacttcag

SEQ ID NO: 7228 - DNA, 18 bp, Homo Sapiens
  primer_bind 1..18: upstream amplification primer 99-3021 for SEQ 3294,
agtatggtgtggagatgg

SEQ ID NO: 7229 - DNA, 18 bp, Homo Sapiens
  primer_bind 1..18: upstream amplification primer 99-3044 for SEQ 3295,
ccctgtcctattactttc

SEQ ID NO: 7230 - DNA, 18 bp, Homo Sapiens
  primer_bind 1..18: upstream amplification primer 99-3045 for SEQ 3296,
tgtctttcccctttccag

SEQ ID NO: 7231 - DNA, 18 bp, Homo Sapiens
  primer_bind 1..18: upstream amplification primer 99-3046 for SEQ 3297,
tcgttgtagaatgtgagg

SEQ ID NO: 7232 - DNA, 18 bp, Homo Sapiens
  primer_bind 1..18: upstream amplification primer 99-3047 for SEQ 3298,
ccttccttcttttggctc

SEQ ID NO: 7233 - DNA, 18 bp, Homo Sapiens
  primer_bind 1..18: upstream amplification primer 99-3058 for SEQ 3299,
ccccagaaataggaagag

SEQ ID NO: 7234 - DNA, 19 bp, Homo Sapiens
  primer_bind 1..19: upstream amplification primer 99-306 for SEQ 3300,
taaacattgaaatggggac

SEQ ID NO: 7235 - DNA, 19 bp, Homo Sapiens
  primer_bind 1..19: upstream amplification primer 99-3061 for SEQ 3301,
gtgcttatagtgtgctaac

SEQ ID NO: 7236 - DNA, 20 bp, Homo Sapiens
  primer_bind 1..20: upstream amplification primer 99-3106 for SEQ 3302,
atccctcttccctcacttcc

SEQ ID NO: 7237 - DNA, 19 bp, Homo Sapiens
  primer_bind 1..19: upstream amplification primer 99-3108 for SEQ 3303,
ttctgagagcatattttcc

SEQ ID NO: 7238 - DNA, 20 bp, Homo Sapiens
  primer_bind 1..20: upstream amplification primer 99-3109 for SEQ 3304,
gaggaagatgaagtgaaatg

SEQ ID NO: 7239 - DNA, 19 bp, Homo Sapiens
  primer_bind 1..19: upstream amplification primer 99-3110 for SEQ 3305,
tttttcttctctttcccac

SEQ ID NO: 7240 - DNA, 20 bp, Homo Sapiens
  primer_bind 1..20: upstream amplification primer 99-312 for SEQ 3306,
aggaggaacagggatgagtg

SEQ ID NO: 7241 - DNA, 19 bp, Homo Sapiens
  primer_bind 1..19: upstream amplification primer 99-3129 for SEQ 3307,
ttccttccccacttccttc

SEQ ID NO: 7242 - DNA, 20 bp, Homo Sapiens
  primer_bind 1..20: upstream amplification primer 99-3132 for SEQ 3308,
caatagatcccacccatgag

SEQ ID NO: 7243 - DNA, 20 bp, Homo Sapiens
  primer_bind 1..20: upstream amplification primer 99-3144 for SEQ 3309,
tggggagatggaagagtctg

SEQ ID NO: 7244 - DNA, 20 bp, Homo Sapiens
  primer_bind 1..20: upstream amplification primer 99-3147 for SEQ 3310,
tgaggtaaaggagaggaggg

SEQ ID NO: 7245 - DNA, 18 bp, Homo Sapiens
  primer_bind 1..18: upstream amplification primer 99-3153 for SEQ 3311,
ttctgtctctgaatctcc

SEQ ID NO: 7246 - DNA, 19 bp, Homo Sapiens
  primer_bind 1..19: upstream amplification primer 99-3154 for SEQ 3312,
tgtggggcaaaataggctc

SEQ ID NO: 7247 - DNA, 18 bp, Homo Sapiens
  primer_bind 1..18: upstream amplification primer 99-3156 for SEQ 3313,
tcatagcagcctgaatgg

SEQ ID NO: 7248 - DNA, 18 bp, Homo Sapiens
  primer_bind 1..18: upstream amplification primer 99-3167 for SEQ 3314,
cctgttcctttgtttgtg

SEQ ID NO: 7249 - DNA, 18 bp, Homo Sapiens
  primer_bind 1..18: upstream amplification primer 99-3195 for SEQ 3315,
atcacatcaagttgagcc

SEQ ID NO: 7250 - DNA, 19 bp, Homo Sapiens
  primer_bind 1..19: upstream amplification primer 99-3217 for SEQ 3316,
tgaattaaagggcaaagac

SEQ ID NO: 7251 - DNA, 19 bp, Homo Sapiens
  primer_bind 1..19: upstream amplification primer 99-3224 for SEQ 3317,
ttctgatactcttgatgac

SEQ ID NO: 7252 - DNA, 18 bp, Homo Sapiens
  primer_bind 1..18: upstream amplification primer 99-3231 for SEQ 3318,
ggtattcattcccctgtc

SEQ ID NO: 7253 - DNA, 19 bp, Homo Sapiens
  primer_bind 1..19: upstream amplification primer 99-3234 for SEQ 3319,
agggtgcaaaatttagtgg

SEQ ID NO: 7254 - DNA, 20 bp, Homo Sapiens
  primer_bind 1..20: upstream amplification primer 99-325 for SEQ 3320,
tccttcagccctttctgtcc

SEQ ID NO: 7255 - DNA, 19 bp, Homo Sapiens
  primer_bind 1..19: upstream amplification primer 99-3266 for SEQ 3321,
tggagagtaagagatgggg

SEQ ID NO: 7256 - DNA, 18 bp, Homo Sapiens
  primer_bind 1..18: upstream amplification primer 99-3276 for SEQ 3322,
ttgctctctctcactcac

SEQ ID NO: 7257 - DNA, 20 bp, Homo Sapiens
  primer_bind 1..20: upstream amplification primer 99-3279 for SEQ 3323,
cttggattaatatctcaggg

SEQ ID NO: 7258 - DNA, 18 bp, Homo Sapiens
  primer_bind 1..18: upstream amplification primer 99-3293 for SEQ 3324,
cgttcaggatattttggg

SEQ ID NO: 7259 - DNA, 18 bp, Homo Sapiens
  primer_bind 1..18: upstream amplification primer 99-3296 for SEQ 3325,
tggttcaaagtcaccgag

SEQ ID NO: 7260 - DNA, 18 bp, Homo Sapiens
  primer_bind 1..18: upstream amplification primer 99-3299 for SEQ 3326,
tttctctgtgttctgagg

SEQ ID NO: 7261 - DNA, 18 bp, Homo Sapiens
  primer_bind 1..18: upstream amplification primer 99-3305 for SEQ 3327,
aagttcttgggctctctc

SEQ ID NO: 7262 - DNA, 19 bp, Homo Sapiens
  primer_bind 1..19: upstream amplification primer 99-3335 for SEQ 3328,
tgttctcagtgcccttgtc

SEQ ID NO: 7263 - DNA, 20 bp, Homo Sapiens
  primer_bind 1..20: upstream amplification primer 99-3337 for SEQ 3329,
tccagttcagtaggtgggtc

SEQ ID NO: 7264 - DNA, 18 bp, Homo Sapiens
  primer_bind 1..18: upstream amplification primer 99-3342 for SEQ 3330,
gattcccttcaatgtctc

SEQ ID NO: 7265 - DNA, 18 bp, Homo Sapiens
  primer_bind 1..18: upstream amplification primer 99-3347 for SEQ 3331,
ataggggaaaataggagg

SEQ ID NO: 7266 - DNA, 19 bp, Homo Sapiens
  primer_bind 1..19: upstream amplification primer 99-3349 for SEQ 3332,
cttactgtgtgcttggttc

SEQ ID NO: 7267 - DNA, 19 bp, Homo Sapiens
  primer_bind 1..19: upstream amplification primer 99-3353 for SEQ 3333,
ctcagaatgtatcccagtc

SEQ ID NO: 7268 - DNA, 18 bp, Homo Sapiens
  primer_bind 1..18: upstream amplification primer 99-3356 for SEQ 3334,
gcagttgttgggcaaatg

SEQ ID NO: 7269 - DNA, 19 bp, Homo Sapiens
  primer_bind 1..19: upstream amplification primer 99-3368 for SEQ 3335,
tttctcactgtcaaggcgg

SEQ ID NO: 7270 - DNA, 18 bp, Homo Sapiens
  primer_bind 1..18: upstream amplification primer 99-3373 for SEQ 3336,
ttcagctcaacaataccc

SEQ ID NO: 7271 - DNA, 18 bp, Homo Sapiens
  primer_bind 1..18: upstream amplification primer 99-3374 for SEQ 3337,
aaggctggaaacaaaggg

SEQ ID NO: 7272 - DNA, 20 bp, Homo Sapiens
  primer_bind 1..20: upstream amplification primer 99-3385 for SEQ 3338,
gtatggatgctaaagtagag

SEQ ID NO: 7273 - DNA, 20 bp, Homo Sapiens
  primer_bind 1..20: upstream amplification primer 99-3390 for SEQ 3339,
gacagagtacattgcttttc

SEQ ID NO: 7274 - DNA, 18 bp, Homo Sapiens
  primer_bind 1..18: upstream amplification primer 99-3391 for SEQ 3340,
caccaagccattgatgag

SEQ ID NO: 7275 - DNA, 21 bp, Homo Sapiens
  primer_bind 1..21: upstream amplification primer 99-3393 for SEQ 3341,
ggaacactattaactcacgac

SEQ ID NO: 7276 - DNA, 21 bp, Homo Sapiens
  primer_bind 1..21: upstream amplification primer 99-3398 for SEQ 3342,
gcaatgccgaattattctgtg

SEQ ID NO: 7277 - DNA, 18 bp, Homo Sapiens
  primer_bind 1..18: upstream amplification primer 99-3399 for SEQ 3343,
ctatttccaacttccgac

SEQ ID NO: 7278 - DNA, 20 bp, Homo Sapiens
  primer_bind 1..20: upstream amplification primer 99-3400 for SEQ 3344,
agtggctgtatctgtgggtg

SEQ ID NO: 7279 - DNA, 20 bp, Homo Sapiens
  primer_bind 1..20: upstream amplification primer 99-3414 for SEQ 3345,
cccattagctcaaattaacg

SEQ ID NO: 7280 - DNA, 21 bp, Homo Sapiens
  primer_bind 1..21: upstream amplification primer 99-3415 for SEQ 3346,
ctaaaatccacagcaaccaac

SEQ ID NO: 7281 - DNA, 20 bp, Homo Sapiens
  primer_bind 1..20: upstream amplification primer 99-3426 for SEQ 3347,
caagaaagaacatttactgg

SEQ ID NO: 7282 - DNA, 19 bp, Homo Sapiens
  primer_bind 1..19: upstream amplification primer 99-3428 for SEQ 3348,
gaaagtgtgtactgacgtg

SEQ ID NO: 7283 - DNA, 21 bp, Homo Sapiens
  primer_bind 1..21: upstream amplification primer 99-3445 for SEQ 3349,
ctaaaattaacacactcacac

SEQ ID NO: 7284 - DNA, 18 bp, Homo Sapiens
  primer_bind 1..18: upstream amplification primer 99-3453 for SEQ 3350,
tgttctcattctgcctcc

SEQ ID NO: 7285 - DNA, 20 bp, Homo Sapiens
  primer_bind 1..20: upstream amplification primer 99-3460 for SEQ 3351,
cctatttctccagcttcatc

SEQ ID NO: 7286 - DNA, 19 bp, Homo Sapiens
  primer_bind 1..19: upstream amplification primer 99-3462 for SEQ 3352,
ggtttgcggtaaagagatg

SEQ ID NO: 7287 - DNA, 18 bp, Homo Sapiens
  primer_bind 1..18: upstream amplification primer 99-3468 for SEQ 3353,
gtagccaagagaaaagag

SEQ ID NO: 7288 - DNA, 19 bp, Homo Sapiens
  primer_bind 1..19: upstream amplification primer 99-3469 for SEQ 3354,
catattctcactacacaac

SEQ ID NO: 7289 - DNA, 19 bp, Homo Sapiens
  primer_bind 1..19: upstream amplification primer 99-3473 for SEQ 3355,
caaaggcagtttactaatc

SEQ ID NO: 7290 - DNA, 19 bp, Homo Sapiens
  primer_bind 1..19: upstream amplification primer 99-3474 for SEQ 3356,
ttcagccagtcagtcactc

SEQ ID NO: 7291 - DNA, 21 bp, Homo Sapiens
  primer_bind 1..21: upstream amplification primer 99-3478 for SEQ 3357,
cagaaagatcaaaggatgagg

SEQ ID NO: 7292 - DNA, 19 bp, Homo Sapiens
  primer_bind 1..19: upstream amplification primer 99-3479 for SEQ 3358,
ggaaaaatggaaatgagag

SEQ ID NO: 7293 - DNA, 18 bp, Homo Sapiens
  primer_bind 1..18: upstream amplification primer 99-3482 for SEQ 3359,
caaaatgtccccgttttc

SEQ ID NO: 7294 - DNA, 20 bp, Homo Sapiens
  primer_bind 1..20: upstream amplification primer 99-3483 for SEQ 3360,
tggtcaagtgagggagacag

SEQ ID NO: 7295 - DNA, 18 bp, Homo Sapiens
  primer_bind 1..18: upstream amplification primer 99-3485 for SEQ 3361,
aaaatgagaccctgggag

SEQ ID NO: 7296 - DNA, 20 bp, Homo Sapiens
  primer_bind 1..20: upstream amplification primer 99-3511 for SEQ 3362,
gtttagtaggcagtaagtgg

SEQ ID NO: 7297 - DNA, 19 bp, Homo Sapiens
  primer_bind 1..19: upstream amplification primer 99-3519 for SEQ 3363,
catcagaactacaaaaagg

SEQ ID NO: 7298 - DNA, 18 bp, Homo Sapiens
  primer_bind 1..18: upstream amplification primer 99-3522 for SEQ 3364,
atatcccatccaatgtcc

SEQ ID NO: 7299 - DNA, 19 bp, Homo Sapiens
  primer_bind 1..19: upstream amplification primer 99-3523 for SEQ 3365,
tgtcttttctcctactttc

SEQ ID NO: 7300 - DNA, 19 bp, Homo Sapiens
  primer_bind 1..19: upstream amplification primer 99-3524 for SEQ 3366,
gaaagagaggaagaaaagg

SEQ ID NO: 7301 - DNA, 19 bp, Homo Sapiens
  primer_bind 1..19: upstream amplification primer 99-3542 for SEQ 3367,
aaatcctcatttttcaccc

SEQ ID NO: 7302 - DNA, 19 bp, Homo Sapiens
  primer_bind 1..19: upstream amplification primer 99-3556 for SEQ 3368,
tttcctatttctatcctcc

SEQ ID NO: 7303 - DNA, 18 bp, Homo Sapiens
  primer_bind 1..18: upstream amplification primer 99-3563 for SEQ 3369,
accacttcttcatcccac

SEQ ID NO: 7304 - DNA, 20 bp, Homo Sapiens
  primer_bind 1..20: upstream amplification primer 99-3580 for SEQ 3370,
aagaccatagcctgtgtccc

SEQ ID NO: 7305 - DNA, 20 bp, Homo Sapiens
  primer_bind 1..20: upstream amplification primer 99-3588 for SEQ 3371,
tctgtcttgagctgtcagcc

SEQ ID NO: 7306 - DNA, 18 bp, Homo Sapiens
  primer_bind 1..18: upstream amplification primer 99-3589 for SEQ 3372,
gatagggttcttctgtgg

SEQ ID NO: 7307 - DNA, 18 bp, Homo Sapiens
  primer_bind 1..18: upstream amplification primer 99-3596 for SEQ 3373,
tgtctgtggttgagctac

SEQ ID NO: 7308 - DNA, 18 bp, Homo Sapiens
  primer_bind 1..18: upstream amplification primer 99-36 for SEQ 3374,
tcctatcccaatcacttc

SEQ ID NO: 7309 - DNA, 20 bp, Homo Sapiens
  primer_bind 1..20: upstream amplification primer 99-3601 for SEQ 3375,
ccttcttttgaacctgacac

SEQ ID NO: 7310 - DNA, 18 bp, Homo Sapiens
  primer_bind 1..18: upstream amplification primer 99-3603 for SEQ 3376,
agaaagtggagagaggag

SEQ ID NO: 7311 - DNA, 18 bp, Homo Sapiens
  primer_bind 1..18: upstream amplification primer 99-3604 for SEQ 3377,
tcatgtcctcatgtcctc

SEQ ID NO: 7312 - DNA, 18 bp, Homo Sapiens
  primer_bind 1..18: upstream amplification primer 99-3619 for SEQ 3378,
aaatgtcctgtgctgctg

SEQ ID NO: 7313 - DNA, 18 bp, Homo Sapiens
  primer_bind 1..18: upstream amplification primer 99-3620 for SEQ 3379,
ggttaaattcacgggagg

SEQ ID NO: 7314 - DNA, 21 bp, Homo Sapiens
  primer_bind 1..21: upstream amplification primer 99-3628 for SEQ 3380,
cctttcttaaacctcctactc

SEQ ID NO: 7315 - DNA, 18 bp, Homo Sapiens
  primer_bind 1..18: upstream amplification primer 99-3629 for SEQ 3381,
aatcaaggttctgccctc

SEQ ID NO: 7316 - DNA, 20 bp, Homo Sapiens
  primer_bind 1..20: upstream amplification primer 99-3631 for SEQ 3382,
gtggggtcattgtttacttc

SEQ ID NO: 7317 - DNA, 18 bp, Homo Sapiens
  primer_bind 1..18: upstream amplification primer 99-3638 for SEQ 3383,
tttgttcctccatcctcc

SEQ ID NO: 7318 - DNA, 21 bp, Homo Sapiens
  primer_bind 1..21: upstream amplification primer 99-3641 for SEQ 3384,
gccactagaagtttccctacc

SEQ ID NO: 7319 - DNA, 19 bp, Homo Sapiens
  primer_bind 1..19: upstream amplification primer 99-3666 for SEQ 3385,
tctaacgggaggcaataac

SEQ ID NO: 7320 - DNA, 18 bp, Homo Sapiens
  primer_bind 1..18: upstream amplification primer 99-3667 for SEQ 3386,
ccagaatactccacctac

SEQ ID NO: 7321 - DNA, 19 bp, Homo Sapiens
  primer_bind 1..19: upstream amplification primer 99-3677 for SEQ 3387,
gtgaacaacagtcagaaag

SEQ ID NO: 7322 - DNA, 18 bp, Homo Sapiens
  primer_bind 1..18: upstream amplification primer 99-3680 for SEQ 3388,
cacttcccttaattccag

SEQ ID NO: 7323 - DNA, 19 bp, Homo Sapiens
  primer_bind 1..19: upstream amplification primer 99-3689 for SEQ 3389,
gatgcccttactgtttgtg

SEQ ID NO: 7324 - DNA, 20 bp, Homo Sapiens
  primer_bind 1..20: upstream amplification primer 99-3690 for SEQ 3390,
caaatgtatcagcatattcc

SEQ ID NO: 7325 - DNA, 20 bp, Homo Sapiens
  primer_bind 1..20: upstream amplification primer 99-3699 for SEQ 3391,
ggatgccaaatactcttcac

SEQ ID NO: 7326 - DNA, 18 bp, Homo Sapiens
  primer_bind 1..18: upstream amplification primer 99-3702 for SEQ 3392,
gcactaagaaaatgcccc

SEQ ID NO: 7327 - DNA, 21 bp, Homo Sapiens
  primer_bind 1..21: upstream amplification primer 99-3703 for SEQ 3393,
cattatgccaatacatttgac

SEQ ID NO: 7328 - DNA, 19 bp, Homo Sapiens
  primer_bind 1..19: upstream amplification primer 99-3705 for SEQ 3394,
ttctatctaactctccctc

SEQ ID NO: 7329 - DNA, 19 bp, Homo Sapiens
  primer_bind 1..19: upstream amplification primer 99-3709 for SEQ 3395,
atcttttctttccctaacc

SEQ ID NO: 7330 - DNA, 20 bp, Homo Sapiens
  primer_bind 1..20: upstream amplification primer 99-3717 for SEQ 3396,
tctgcggtggtgagtgttag

SEQ ID NO: 7331 - DNA, 19 bp, Homo Sapiens
  primer_bind 1..19: upstream amplification primer 99-3728 for SEQ 3397,
attaggctgaaaacactac

SEQ ID NO: 7332 - DNA, 18 bp, Homo Sapiens
  primer_bind 1..18: upstream amplification primer 99-3739 for SEQ 3398,
ttctgttcctgcccaaag

SEQ ID NO: 7333 - DNA, 18 bp, Homo Sapiens
  primer_bind 1..18: upstream amplification primer 99-3746 for SEQ 3399,
cttcagtctaacgctctc

SEQ ID NO: 7334 - DNA, 18 bp, Homo Sapiens
  primer_bind 1..18: upstream amplification primer 99-3749 for SEQ 3400,
tagagaagctgtgtaacc

SEQ ID NO: 7335 - DNA, 18 bp, Homo Sapiens
  primer_bind 1..18: upstream amplification primer 99-3752 for SEQ 3401,
ttccaagtgcttattgcc

SEQ ID NO: 7336 - DNA, 20 bp, Homo Sapiens
  primer_bind 1..20: upstream amplification primer 99-3760 for SEQ 3402,
cagaagactatggatttggg

SEQ ID NO: 7337 - DNA, 18 bp, Homo Sapiens
  primer_bind 1..18: upstream amplification primer 99-3761 for SEQ 3403,
tggagcaatacattgggg

SEQ ID NO: 7338 - DNA, 19 bp, Homo Sapiens
  primer_bind 1..19: upstream amplification primer 99-3764 for SEQ 3404,
gtaaaacccaaaatgagag

SEQ ID NO: 7339 - DNA, 18 bp, Homo Sapiens
  primer_bind 1..18: upstream amplification primer 99-3765 for SEQ 3405,
cctcaattccccaatttc

SEQ ID NO: 7340 - DNA, 18 bp, Homo Sapiens
  primer_bind 1..18: upstream amplification primer 99-377 for SEQ 3406,
gtccacattttagtcccc

SEQ ID NO: 7341 - DNA, 18 bp, Homo Sapiens
  primer_bind 1..18: upstream amplification primer 99-3773 for SEQ 3407,
agatgtgatgctatgggg

SEQ ID NO: 7342 - DNA, 19 bp, Homo Sapiens
  primer_bind 1..19: upstream amplification primer 99-3774 for SEQ 3408,
ttccccttcaaccacaacc

SEQ ID NO: 7343 - DNA, 19 bp, Homo Sapiens
  primer_bind 1..19: upstream amplification primer 99-3775 for SEQ 3409,
ttagttcagtgtaaaaccc

SEQ ID NO: 7344 - DNA, 18 bp, Homo Sapiens
  primer_bind 1..18: upstream amplification primer 99-3778 for SEQ 3410,
acccttggaaatgccttg

SEQ ID NO: 7345 - DNA, 20 bp, Homo Sapiens
  primer_bind 1..20: upstream amplification primer 99-3789 for SEQ 3411,
gtttggcttattatagtctg

SEQ ID NO: 7346 - DNA, 19 bp, Homo Sapiens
  primer_bind 1..19: upstream amplification primer 99-3792 for SEQ 3412,
aggacagtgagcaagacag

SEQ ID NO: 7347 - DNA, 19 bp, Homo Sapiens
  primer_bind 1..19: upstream amplification primer 99-3802 for SEQ 3413,
caaagtcatagtgataggg

SEQ ID NO: 7348 - DNA, 19 bp, Homo Sapiens
  primer_bind 1..19: upstream amplification primer 99-3805 for SEQ 3414,
cttgagattctgcttacac

SEQ ID NO: 7349 - DNA, 19 bp, Homo Sapiens
  primer_bind 1..19: upstream amplification primer 99-3812 for SEQ 3415,
gaaggacagaacagagaac

SEQ ID NO: 7350 - DNA, 21 bp, Homo Sapiens
  primer_bind 1..21: upstream amplification primer 99-3813 for SEQ 3416,
ggtgtgcatgtttcaaaatag

SEQ ID NO: 7351 - DNA, 19 bp, Homo Sapiens
  primer_bind 1..19: upstream amplification primer 99-3857 for SEQ 3417,
gatggttactgagttgaag

SEQ ID NO: 7352 - DNA, 18 bp, Homo Sapiens
  primer_bind 1..18: upstream amplification primer 99-3862 for SEQ 3418,
aactccactcaaccactg

SEQ ID NO: 7353 - DNA, 21 bp, Homo Sapiens
  primer_bind 1..21: upstream amplification primer 99-3875 for SEQ 3419,
gtgtgttgaaatgtggagttg

SEQ ID NO: 7354 - DNA, 19 bp, Homo Sapiens
  primer_bind 1..19: upstream amplification primer 99-3888 for SEQ 3420,
tgaaagcagccagcaagac

SEQ ID NO: 7355 - DNA, 20 bp, Homo Sapiens
  primer_bind 1..20: upstream amplification primer 99-3893 for SEQ 3421,
ctgggtttctgctttatttg

SEQ ID NO: 7356 - DNA, 18 bp, Homo Sapiens
  primer_bind 1..18: upstream amplification primer 99-3941 for SEQ 3422,
tacccaacagaagtccag

SEQ ID NO: 7357 - DNA, 19 bp, Homo Sapiens
  primer_bind 1..19: upstream amplification primer 99-3944 for SEQ 3423,
cttcccaccttttcattcc

SEQ ID NO: 7358 - DNA, 20 bp, Homo Sapiens
  primer_bind 1..20: upstream amplification primer 99-3953 for SEQ 3424,
acgctggacattggatctgg

SEQ ID NO: 7359 - DNA, 19 bp, Homo Sapiens
  primer_bind 1..19: upstream amplification primer 99-3954 for SEQ 3425,
gcaaagccatttctaactc

SEQ ID NO: 7360 - DNA, 18 bp, Homo Sapiens
  primer_bind 1..18: upstream amplification primer 99-3978 for SEQ 3426,
ccatcaccacaagaatcc

SEQ ID NO: 7361 - DNA, 19 bp, Homo Sapiens
  primer_bind 1..19: upstream amplification primer 99-3981 for SEQ 3427,
caacaaaaaaaacccccac

SEQ ID NO: 7362 - DNA, 18 bp, Homo Sapiens
  primer_bind 1..18: upstream amplification primer 99-3992 for SEQ 3428,
ttgctaagaacctatgcc

SEQ ID NO: 7363 - DNA, 20 bp, Homo Sapiens
  primer_bind 1..20: upstream amplification primer 99-4001 for SEQ 3429,
tgacccagcaccttgctatg

SEQ ID NO: 7364 - DNA, 20 bp, Homo Sapiens
  primer_bind 1..20: upstream amplification primer 99-4009 for SEQ 3430,
ccacacattcaatctatgag

SEQ ID NO: 7365 - DNA, 18 bp, Homo Sapiens
  primer_bind 1..18: upstream amplification primer 99-4025 for SEQ 3431,
cagaatctttggggaagg

SEQ ID NO: 7366 - DNA, 19 bp, Homo Sapiens
  primer_bind 1..19: upstream amplification primer 99-4052 for SEQ 3432,
tataagtagtggcaaagtg

SEQ ID NO: 7367 - DNA, 21 bp, Homo Sapiens
  primer_bind 1..21: upstream amplification primer 99-4064 for SEQ 3433,
tataggattagcttccttccc

SEQ ID NO: 7368 - DNA, 19 bp, Homo Sapiens
  primer_bind 1..19: upstream amplification primer 99-4065 for SEQ 3434,
cattatctcattgctgttc

SEQ ID NO: 7369 - DNA, 18 bp, Homo Sapiens
  primer_bind 1..18: upstream amplification primer 99-4073 for SEQ 3435,
aaggtgctgatctccttc

SEQ ID NO: 7370 - DNA, 20 bp, Homo Sapiens
  primer_bind 1..20: upstream amplification primer 99-4076 for SEQ 3436,
ctaataccttagtgtgatcc

SEQ ID NO: 7371 - DNA, 20 bp, Homo Sapiens
  primer_bind 1..20: upstream amplification primer 99-4077 for SEQ 3437,
tgggggaagaaggtggtttg

SEQ ID NO: 7372 - DNA, 18 bp, Homo Sapiens
  primer_bind 1..18: upstream amplification primer 99-4078 for SEQ 3438,
acaatccctccaaaagac

SEQ ID NO: 7373 - DNA, 18 bp, Homo Sapiens
  primer_bind 1..18: upstream amplification primer 99-4079 for SEQ 3439,
gagctttgtcattcagcc

SEQ ID NO: 7374 - DNA, 20 bp, Homo Sapiens
  primer_bind 1..20: upstream amplification primer 99-4119 for SEQ 3440,
aagatggtagattttgtgtc

SEQ ID NO: 7375 - DNA, 18 bp, Homo Sapiens
  primer_bind 1..18: upstream amplification primer 99-4120 for SEQ 3441,
gttgaggaaatgagacag

SEQ ID NO: 7376 - DNA, 18 bp, Homo Sapiens
  primer_bind 1..18: upstream amplification primer 99-4122 for SEQ 3442,
tatagataggtcacccac

SEQ ID NO: 7377 - DNA, 18 bp, Homo Sapiens
  primer_bind 1..18: upstream amplification primer 99-4125 for SEQ 3443,
cagatattaccgccagag

SEQ ID NO: 7378 - DNA, 21 bp, Homo Sapiens
  primer_bind 1..21: upstream amplification primer 99-4131 for SEQ 3444,
atattttctaacctagtctgg

SEQ ID NO: 7379 - DNA, 21 bp, Homo Sapiens
  primer_bind 1..21: upstream amplification primer 99-4138 for SEQ 3445,
gcacaactctaaaccaaacac

SEQ ID NO: 7380 - DNA, 18 bp, Homo Sapiens
  primer_bind 1..18: upstream amplification primer 99-4139 for SEQ 3446,
gcgttcttcatctagttg

SEQ ID NO: 7381 - DNA, 20 bp, Homo Sapiens
  primer_bind 1..20: upstream amplification primer 99-4140 for SEQ 3447,
accctgtatcctgatgaccc

SEQ ID NO: 7382 - DNA, 19 bp, Homo Sapiens
  primer_bind 1..19: upstream amplification primer 99-4182 for SEQ 3448,
taaaaagccaagagcttac

SEQ ID NO: 7383 - DNA, 20 bp, Homo Sapiens
  primer_bind 1..20: upstream amplification primer 99-4193 for SEQ 3449,
ccactaaaagcaagtagctg

SEQ ID NO: 7384 - DNA, 20 bp, Homo Sapiens
  primer_bind 1..20: upstream amplification primer 99-4194 for SEQ 3450,
gatatacttggctaatgtcc

SEQ ID NO: 7385 - DNA, 20 bp, Homo Sapiens
  primer_bind 1..20: upstream amplification primer 99-4199 for SEQ 3451,
tcccatcttaccctcccttc

SEQ ID NO: 7386 - DNA, 18 bp, Homo Sapiens
  primer_bind 1..18: upstream amplification primer 99-4201 for SEQ 3452,
cttttctgattctcccac

SEQ ID NO: 7387 - DNA, 19 bp, Homo Sapiens
  primer_bind 1..19: upstream amplification primer 99-4202 for SEQ 3453,
ctattggaaacacaagggg

SEQ ID NO: 7388 - DNA, 18 bp, Homo Sapiens
  primer_bind 1..18: upstream amplification primer 99-4203 for SEQ 3454,
actgttctatgctgcacc

SEQ ID NO: 7389 - DNA, 18 bp, Homo Sapiens
  primer_bind 1..18: upstream amplification primer 99-4207 for SEQ 3455,
cttcacctctctttccac

SEQ ID NO: 7390 - DNA, 18 bp, Homo Sapiens
  primer_bind 1..18: upstream amplification primer 99-4218 for SEQ 3456,
ataacaaaccccaaaccg

SEQ ID NO: 7391 - DNA, 20 bp, Homo Sapiens
  primer_bind 1..20: upstream amplification primer 99-4220 for SEQ 3457,
agtggacctaagggctgttg

SEQ ID NO: 7392 - DNA, 19 bp, Homo Sapiens
  primer_bind 1..19: upstream amplification primer 99-4225 for SEQ 3458,
agatgtgtccccagcatag

SEQ ID NO: 7393 - DNA, 19 bp, Homo Sapiens
  primer_bind 1..19: upstream amplification primer 99-4231 for SEQ 3459,
aatcctacatgcctccacc

SEQ ID NO: 7394 - DNA, 18 bp, Homo Sapiens
  primer_bind 1..18: upstream amplification primer 99-4232 for SEQ 3460,
tgtactctcacagcttgg

SEQ ID NO: 7395 - DNA, 18 bp, Homo Sapiens
  primer_bind 1..18: upstream amplification primer 99-4233 for SEQ 3461,
ctctgctcaacagtattc

SEQ ID NO: 7396 - DNA, 20 bp, Homo Sapiens
  primer_bind 1..20: upstream amplification primer 99-4238 for SEQ 3462,
ggaaaataggaaacatccag

SEQ ID NO: 7397 - DNA, 20 bp, Homo Sapiens
  primer_bind 1..20: upstream amplification primer 99-4251 for SEQ 3463,
tggcagctacctactctatc

SEQ ID NO: 7398 - DNA, 18 bp, Homo Sapiens
  primer_bind 1..18: upstream amplification primer 99-4266 for SEQ 3464,
ccacaaagaaaactccag

SEQ ID NO: 7399 - DNA, 18 bp, Homo Sapiens
  primer_bind 1..18: upstream amplification primer 99-4272 for SEQ 3465,
aattcagacccctttccc

SEQ ID NO: 7400 - DNA, 18 bp, Homo Sapiens
  primer_bind 1..18: upstream amplification primer 99-4283 for SEQ 3466,
gatgaacataccacgaac

SEQ ID NO: 7401 - DNA, 18 bp, Homo Sapiens
  primer_bind 1..18: upstream amplification primer 99-4284 for SEQ 3467,
atctttcacagccttccc

SEQ ID NO: 7402 - DNA, 18 bp, Homo Sapiens
  primer_bind 1..18: upstream amplification primer 99-4285 for SEQ 3468,
aaacgagaaggaaggatg

SEQ ID NO: 7403 - DNA, 21 bp, Homo Sapiens
  primer_bind 1..21: upstream amplification primer 99-4290 for SEQ 3469,
ggataggataggatagagttg

SEQ ID NO: 7404 - DNA, 19 bp, Homo Sapiens
  primer_bind 1..19: upstream amplification primer 99-4293 for SEQ 3470,
ttcatcaaccaacctcccc

SEQ ID NO: 7405 - DNA, 18 bp, Homo Sapiens
  primer_bind 1..18: upstream amplification primer 99-4296 for SEQ 3471,
cagaggtttgcgaaacag

SEQ ID NO: 7406 - DNA, 19 bp, Homo Sapiens
  primer_bind 1..19: upstream amplification primer 99-4312 for SEQ 3472,
ttccccaaacctgaacacc

SEQ ID NO: 7407 - DNA, 20 bp, Homo Sapiens
  primer_bind 1..20: upstream amplification primer 99-4323 for SEQ 3473,
gtagaggtaatagtgagtgg

SEQ ID NO: 7408 - DNA, 18 bp, Homo Sapiens
  primer_bind 1..18: upstream amplification primer 99-4325 for SEQ 3474,
gataagcattcaccttcc

SEQ ID NO: 7409 - DNA, 18 bp, Homo Sapiens
  primer_bind 1..18: upstream amplification primer 99-4332 for SEQ 3475,
gacctccagtcaaaaaag

SEQ ID NO: 7410 - DNA, 18 bp, Homo Sapiens
  primer_bind 1..18: upstream amplification primer 99-4335 for SEQ 3476,
aaggaggtgaaaaggagg

SEQ ID NO: 7411 - DNA, 19 bp, Homo Sapiens
  primer_bind 1..19: upstream amplification primer 99-4336 for SEQ 3477,
agttttctctggtttgttc

SEQ ID NO: 7412 - DNA, 20 bp, Homo Sapiens
  primer_bind 1..20: upstream amplification primer 99-4337 for SEQ 3478,
catgcaagattcaagcatcc

SEQ ID NO: 7413 - DNA, 18 bp, Homo Sapiens
  primer_bind 1..18: upstream amplification primer 99-4339 for SEQ 3479,
gcctctatcagtcattcc

SEQ ID NO: 7414 - DNA, 18 bp, Homo Sapiens
  primer_bind 1..18: upstream amplification primer 99-4358 for SEQ 3480,
tcgttcaggtgcagtttc

SEQ ID NO: 7415 - DNA, 20 bp, Homo Sapiens
  primer_bind 1..20: upstream amplification primer 99-4364 for SEQ 3481,
catacacacatatttagctc

SEQ ID NO: 7416 - DNA, 18 bp, Homo Sapiens
  primer_bind 1..18: upstream amplification primer 99-4398 for SEQ 3482,
atgacaagtgactcaggg

SEQ ID NO: 7417 - DNA, 18 bp, Homo Sapiens
  primer_bind 1..18: upstream amplification primer 99-4399 for SEQ 3483,
caaacttcctcttgcttc

SEQ ID NO: 7418 - DNA, 21 bp, Homo Sapiens
  primer_bind 1..21: upstream amplification primer 99-4404 for SEQ 3484,
cttcccatgctaagaagccac

SEQ ID NO: 7419 - DNA, 18 bp, Homo Sapiens
  primer_bind 1..18: upstream amplification primer 99-4406 for SEQ 3485,
tgcctaaatccccatttc

SEQ ID NO: 7420 - DNA, 19 bp, Homo Sapiens
  primer_bind 1..19: upstream amplification primer 99-4435 for SEQ 3486,
ccttgtgtttgtgtttgtg

SEQ ID NO: 7421 - DNA, 18 bp, Homo Sapiens
  primer_bind 1..18: upstream amplification primer 99-4448 for SEQ 3487,
cacagggaatagcatgac

SEQ ID NO: 7422 - DNA, 20 bp, Homo Sapiens
  primer_bind 1..20: upstream amplification primer 99-4455 for SEQ 3488,
gaaactagaagaattggaac

SEQ ID NO: 7423 - DNA, 20 bp, Homo Sapiens
  primer_bind 1..20: upstream amplification primer 99-4458 for SEQ 3489,
cttagaataatgcctcctcc

SEQ ID NO: 7424 - DNA, 18 bp, Homo Sapiens
  primer_bind 1..18: upstream amplification primer 99-4467 for SEQ 3490,
tttatgagatgggctctg

SEQ ID NO: 7425 - DNA, 19 bp, Homo Sapiens
  primer_bind 1..19: upstream amplification primer 99-4468 for SEQ 3491,
ctgttatttactaagcccc

SEQ ID NO: 7426 - DNA, 19 bp, Homo Sapiens
  primer_bind 1..19: upstream amplification primer 99-4483 for SEQ 3492,
gtcttttttcctcttcttc

SEQ ID NO: 7427 - DNA, 20 bp, Homo Sapiens
  primer_bind 1..20: upstream amplification primer 99-4534 for SEQ 3493,
ggaaagataatacaacatgg

SEQ ID NO: 7428 - DNA, 18 bp, Homo Sapiens
  primer_bind 1..18: upstream amplification primer 99-4567 for SEQ 3494,
gctgtgactctgttttcc

SEQ ID NO: 7429 - DNA, 19 bp, Homo Sapiens
  primer_bind 1..19: upstream amplification primer 99-4575 for SEQ 3495,
aaatggcataaatggcaag

SEQ ID NO: 7430 - DNA, 20 bp, Homo Sapiens
  primer_bind 1..20: upstream amplification primer 99-4580 for SEQ 3496,
tgagcgttctttcctgtccc

SEQ ID NO: 7431 - DNA, 20 bp, Homo Sapiens
  primer_bind 1..20: upstream amplification primer 99-4589 for SEQ 3497,
caccatttatagtcacatag

SEQ ID NO: 7432 - DNA, 18 bp, Homo Sapiens
  primer_bind 1..18: upstream amplification primer 99-4614 for SEQ 3498,
ctttggttattggggttc

SEQ ID NO: 7433 - DNA, 18 bp, Homo Sapiens
  primer_bind 1..18: upstream amplification primer 99-4619 for SEQ 3499,
cacgatggaaaatctctc

SEQ ID NO: 7434 - DNA, 19 bp, Homo Sapiens
  primer_bind 1..19: upstream amplification primer 99-4636 for SEQ 3500,
tgatatttcatctccctgg

SEQ ID NO: 7435 - DNA, 18 bp, Homo Sapiens
  primer_bind 1..18: upstream amplification primer 99-4649 for SEQ 3501,
tggtttcccatgttgcag

SEQ ID NO: 7436 - DNA, 18 bp, Homo Sapiens
  primer_bind 1..18: upstream amplification primer 99-468 for SEQ 3502,
tagcaaacaagggaccag

SEQ ID NO: 7437 - DNA, 18 bp, Homo Sapiens
  primer_bind 1..18: upstream amplification primer 99-4688 for SEQ 3503,
agtgtacccaaccacttc

SEQ ID NO: 7438 - DNA, 18 bp, Homo Sapiens
  primer_bind 1..18: upstream amplification primer 99-4691 for SEQ 3504,
ccttttgctcttttgtcc

SEQ ID NO: 7439 - DNA, 18 bp, Homo Sapiens
  primer_bind 1..18: upstream amplification primer 99-4692 for SEQ 3505,
gagaactgctgtagacac

SEQ ID NO: 7440 - DNA, 18 bp, Homo Sapiens
  primer_bind 1..18: upstream amplification primer 99-4715 for SEQ 3506,
ggctattttgctagtagg

SEQ ID NO: 7441 - DNA, 18 bp, Homo Sapiens
  primer_bind 1..18: upstream amplification primer 99-4736 for SEQ 3507,
gaaaccagtccactgtag

SEQ ID NO: 7442 - DNA, 18 bp, Homo Sapiens
  primer_bind 1..18: upstream amplification primer 99-4744 for SEQ 3508,
tatcaggtgtttaccctc

SEQ ID NO: 7443 - DNA, 18 bp, Homo Sapiens
  primer_bind 1..18: upstream amplification primer 99-4746 for SEQ 3509,
gccaaggaggaatttcag

SEQ ID NO: 7444 - DNA, 18 bp, Homo Sapiens
  primer_bind 1..18: upstream amplification primer 99-4748 for SEQ 3510,
gtaaaggaaaggtgaggg

SEQ ID NO: 7445 - DNA, 18 bp, Homo Sapiens
  primer_bind 1..18: upstream amplification primer 99-4755 for SEQ 3511,
gtgctagttatgtaagcc

SEQ ID NO: 7446 - DNA, 19 bp, Homo Sapiens
  primer_bind 1..19: upstream amplification primer 99-4758 for SEQ 3512,
caatactttgtgttgcctc

SEQ ID NO: 7447 - DNA, 18 bp, Homo Sapiens
  primer_bind 1..18: upstream amplification primer 99-4772 for SEQ 3513,
gtaaacggtagacagttc

SEQ ID NO: 7448 - DNA, 20 bp, Homo Sapiens
  primer_bind 1..20: upstream amplification primer 99-4791 for SEQ 3514,
catggtaggcatctaatcag

SEQ ID NO: 7449 - DNA, 18 bp, Homo Sapiens
  primer_bind 1..18: upstream amplification primer 99-4792 for SEQ 3515,
tttagcagtcctagtcac

SEQ ID NO: 7450 - DNA, 19 bp, Homo Sapiens
  primer_bind 1..19: upstream amplification primer 99-4799 for SEQ 3516,
agttattgccttctcattc

SEQ ID NO: 7451 - DNA, 20 bp, Homo Sapiens
  primer_bind 1..20: upstream amplification primer 99-480 for SEQ 3517,
gagaatgtaaatagtgtgag

SEQ ID NO: 7452 - DNA, 19 bp, Homo Sapiens
  primer_bind 1..19: upstream amplification primer 99-4810 for SEQ 3518,
agtggagtgctggtcttac

SEQ ID NO: 7453 - DNA, 19 bp, Homo Sapiens
  primer_bind 1..19: upstream amplification primer 99-4825 for SEQ 3519,
aattaaccaccacatcttc

SEQ ID NO: 7454 - DNA, 19 bp, Homo Sapiens
  primer_bind 1..19: upstream amplification primer 99-4832 for SEQ 3520,
gctatctaggctgattaac

SEQ ID NO: 7455 - DNA, 19 bp, Homo Sapiens
  primer_bind 1..19: upstream amplification primer 99-4837 for SEQ 3521,
gtccttcagttctttctcc

SEQ ID NO: 7456 - DNA, 18 bp, Homo Sapiens
  primer_bind 1..18: upstream amplification primer 99-4856 for SEQ 3522,
ctgaattgccccctattg

SEQ ID NO: 7457 - DNA, 19 bp, Homo Sapiens
  primer_bind 1..19: upstream amplification primer 99-4871 for SEQ 3523,
tgagttcaccagagaagcc

SEQ ID NO: 7458 - DNA, 19 bp, Homo Sapiens
  primer_bind 1..19: upstream amplification primer 99-4874 for SEQ 3524,
gcccacccttacttttgag

SEQ ID NO: 7459 - DNA, 18 bp, Homo Sapiens
  primer_bind 1..18: upstream amplification primer 99-4885 for SEQ 3525,
atcaggacaaaaggtcag

SEQ ID NO: 7460 - DNA, 18 bp, Homo Sapiens
  primer_bind 1..18: upstream amplification primer 99-49 for SEQ 3526,
agaaatccacagtcagag

SEQ ID NO: 7461 - DNA, 19 bp, Homo Sapiens
  primer_bind 1..19: upstream amplification primer 99-4903 for SEQ 3527,
attcatgcgaatacatgac

SEQ ID NO: 7462 - DNA, 20 bp, Homo Sapiens
  primer_bind 1..20: upstream amplification primer 99-499 for SEQ 3528,
gagtcaaaatgagtatttcc

SEQ ID NO: 7463 - DNA, 18 bp, Homo Sapiens
  primer_bind 1..18: upstream amplification primer 99-5059 for SEQ 3529,
ctgtgaggacaagtcagc

SEQ ID NO: 7464 - DNA, 18 bp, Homo Sapiens
  primer_bind 1..18: upstream amplification primer 99-5074 for SEQ 3530,
ttggtttccagttacctc

SEQ ID NO: 7465 - DNA, 19 bp, Homo Sapiens
  primer_bind 1..19: upstream amplification primer 99-5076 for SEQ 3531,
tagctggttactttactgc

SEQ ID NO: 7466 - DNA, 18 bp, Homo Sapiens
  primer_bind 1..18: upstream amplification primer 99-5098 for SEQ 3532,
ccttttcacctaacatcc

SEQ ID NO: 7467 - DNA, 18 bp, Homo Sapiens
  primer_bind 1..18: upstream amplification primer 99-51 for SEQ 3533,
tgttgagactccctcccc

SEQ ID NO: 7468 - DNA, 18 bp, Homo Sapiens
  primer_bind 1..18: upstream amplification primer 99-5112 for SEQ 3534,
gagctactatttgacccc

SEQ ID NO: 7469 - DNA, 18 bp, Homo Sapiens
  primer_bind 1..18: upstream amplification primer 99-515 for SEQ 3535,
taaaggagcattgtcagc

SEQ ID NO: 7470 - DNA, 18 bp, Homo Sapiens
  primer_bind 1..18: upstream amplification primer 99-5166 for SEQ 3536,
caacattctgaacactgg

SEQ ID NO: 7471 - DNA, 20 bp, Homo Sapiens
  primer_bind 1..20: upstream amplification primer 99-5167 for SEQ 3537,
gattacagaaagttatcgcc

SEQ ID NO: 7472 - DNA, 18 bp, Homo Sapiens
  primer_bind 1..18: upstream amplification primer 99-5176 for SEQ 3538,
taaatagggaagcgagag

SEQ ID NO: 7473 - DNA, 20 bp, Homo Sapiens
  primer_bind 1..20: upstream amplification primer 99-5240 for SEQ 3539,
cactgctacatttatgtaag

SEQ ID NO: 7474 - DNA, 21 bp, Homo Sapiens
  primer_bind 1..21: upstream amplification primer 99-5329 for SEQ 3540,
cattcttcatgttgtcgcttc

SEQ ID NO: 7475 - DNA, 18 bp, Homo Sapiens
  primer_bind 1..18: upstream amplification primer 99-5339 for SEQ 3541,
acccttgtctgtatatcc

SEQ ID NO: 7476 - DNA, 19 bp, Homo Sapiens
  primer_bind 1..19: upstream amplification primer 99-5347 for SEQ 3542,
gtgtttaatcattgcaggg

SEQ ID NO: 7477 - DNA, 20 bp, Homo Sapiens
  primer_bind 1..20: upstream amplification primer 99-5397 for SEQ 3543,
ctaagtggattctcattcag

SEQ ID NO: 7478 - DNA, 18 bp, Homo Sapiens
  primer_bind 1..18: upstream amplification primer 99-55 for SEQ 3544,
ctaatgggatttcactgg

SEQ ID NO: 7479 - DNA, 18 bp, Homo Sapiens
  primer_bind 1..18: upstream amplification primer 99-5549 for SEQ 3545,
gaaaactgcactttcgac

SEQ ID NO: 7480 - DNA, 20 bp, Homo Sapiens
  primer_bind 1..20: upstream amplification primer 99-5569 for SEQ 3546,
cagcatacaactgttatgtg

SEQ ID NO: 7481 - DNA, 20 bp, Homo Sapiens
  primer_bind 1..20: upstream amplification primer 99-5575 for SEQ 3547,
gaaaaattgtttgtgctctg

SEQ ID NO: 7482 - DNA, 19 bp, Homo Sapiens
  primer_bind 1..19: upstream amplification primer 99-5602 for SEQ 3548,
atttttcatggcttggtgg

SEQ ID NO: 7483 - DNA, 21 bp, Homo Sapiens
  primer_bind 1..21: upstream amplification primer 99-5671 for SEQ 3549,
gcacaatcacacagcttaccc

SEQ ID NO: 7484 - DNA, 19 bp, Homo Sapiens
  primer_bind 1..19: upstream amplification primer 99-568 for SEQ 3550,
gttgtagacctcaaattgc

SEQ ID NO: 7485 - DNA, 20 bp, Homo Sapiens
  primer_bind 1..20: upstream amplification primer 99-5688 for SEQ 3551,
aggaaggttttaggaggggg

SEQ ID NO: 7486 - DNA, 21 bp, Homo Sapiens
  primer_bind 1..21: upstream amplification primer 99-5689 for SEQ 3552,
actgcatgtgcgtaaaatgtc

SEQ ID NO: 7487 - DNA, 21 bp, Homo Sapiens
  primer_bind 1..21: upstream amplification primer 99-5715 for SEQ 3553,
ctttttcttggtggtgctttg

SEQ ID NO: 7488 - DNA, 20 bp, Homo Sapiens
  primer_bind 1..20: upstream amplification primer 99-5718 for SEQ 3554,
catgcagacatcataaaacc

SEQ ID NO: 7489 - DNA, 20 bp, Homo Sapiens
  primer_bind 1..20: upstream amplification primer 99-5723 for SEQ 3555,
actgaggactgggtcactac

SEQ ID NO: 7490 - DNA, 20 bp, Homo Sapiens
  primer_bind 1..20: upstream amplification primer 99-5747 for SEQ 3556,
tcagccctttcccagcttac

SEQ ID NO: 7491 - DNA, 21 bp, Homo Sapiens
  primer_bind 1..21: upstream amplification primer 99-5775 for SEQ 3557,
gcaatgtgaaattgacataag

SEQ ID NO: 7492 - DNA, 18 bp, Homo Sapiens
  primer_bind 1..18: upstream amplification primer 99-5828 for SEQ 3558,
aatgcaggcaagatatgg

SEQ ID NO: 7493 - DNA, 21 bp, Homo Sapiens
  primer_bind 1..21: upstream amplification primer 99-5846 for SEQ 3559,
cgaacagtaaagtcagtcagg

SEQ ID NO: 7494 - DNA, 21 bp, Homo Sapiens
  primer_bind 1..21: upstream amplification primer 99-5861 for SEQ 3560,
ggagttccaataaaggcgaag

SEQ ID NO: 7495 - DNA, 18 bp, Homo Sapiens
  primer_bind 1..18: upstream amplification primer 99-59 for SEQ 3561,
cagggtattagcatgagc

SEQ ID NO: 7496 - DNA, 19 bp, Homo Sapiens
  primer_bind 1..19: upstream amplification primer 99-5930 for SEQ 3562,
cccagatggtagacgtatc

SEQ ID NO: 7497 - DNA, 19 bp, Homo Sapiens
  primer_bind 1..19: upstream amplification primer 99-5931 for SEQ 3563,
atttgcttttgttttgccc

SEQ ID NO: 7498 - DNA, 20 bp, Homo Sapiens
  primer_bind 1..20: upstream amplification primer 99-5967 for SEQ 3564,
gctacatccaataatttgtc

SEQ ID NO: 7499 - DNA, 18 bp, Homo Sapiens
  primer_bind 1..18: upstream amplification primer 99-5987 for SEQ 3565,
ttctcacatcttcccttc

SEQ ID NO: 7500 - DNA, 21 bp, Homo Sapiens
  primer_bind 1..21: upstream amplification primer 99-5996 for SEQ 3566,
tgttctgctctttaatctccc

SEQ ID NO: 7501 - DNA, 20 bp, Homo Sapiens
  primer_bind 1..20: upstream amplification primer 99-6001 for SEQ 3567,
tagggctttcagggtttggg

SEQ ID NO: 7502 - DNA, 18 bp, Homo Sapiens
  primer_bind 1..18: upstream amplification primer 99-6020 for SEQ 3568,
cttctcattctaccactc

SEQ ID NO: 7503 - DNA, 18 bp, Homo Sapiens
  primer_bind 1..18: upstream amplification primer 99-6047 for SEQ 3569,
agcgaatgtgggtcatag

SEQ ID NO: 7504 - DNA, 18 bp, Homo Sapiens
  primer_bind 1..18: upstream amplification primer 99-6071 for SEQ 3570,
tttcagcataacgcttgg

SEQ ID NO: 7505 - DNA, 18 bp, Homo Sapiens
  primer_bind 1..18: upstream amplification primer 99-6076 for SEQ 3571,
aagttgtaaccattcccc

SEQ ID NO: 7506 - DNA, 18 bp, Homo Sapiens
  primer_bind 1..18: upstream amplification primer 99-6096 for SEQ 3572,
cccctacacaaacctttc

SEQ ID NO: 7507 - DNA, 18 bp, Homo Sapiens
  primer_bind 1..18: upstream amplification primer 99-6103 for SEQ 3573,
agtccttagaatagcacc

SEQ ID NO: 7508 - DNA, 19 bp, Homo Sapiens
  primer_bind 1..19: upstream amplification primer 99-6124 for SEQ 3574,
aagtttcattgtcaaaggg

SEQ ID NO: 7509 - DNA, 18 bp, Homo Sapiens
  primer_bind 1..18: upstream amplification primer 99-6173 for SEQ 3575,
aatcacgggctcaagatg

SEQ ID NO: 7510 - DNA, 18 bp, Homo Sapiens
  primer_bind 1..18: upstream amplification primer 99-634 for SEQ 3576,
tacagagttgaacatccc

SEQ ID NO: 7511 - DNA, 20 bp, Homo Sapiens
  primer_bind 1..20: upstream amplification primer 99-6401 for SEQ 3577,
tgcccttctaccttcctgac

SEQ ID NO: 7512 - DNA, 18 bp, Homo Sapiens
  primer_bind 1..18: upstream amplification primer 99-6538 for SEQ 3578,
gtccaagcatacaatgtg

SEQ ID NO: 7513 - DNA, 18 bp, Homo Sapiens
  primer_bind 1..18: upstream amplification primer 99-6549 for SEQ 3579,
gaacaaacagaccagaag

SEQ ID NO: 7514 - DNA, 18 bp, Homo Sapiens
  primer_bind 1..18: upstream amplification primer 99-6564 for SEQ 3580,
gtaggaaggggaatgatg

SEQ ID NO: 7515 - DNA, 18 bp, Homo Sapiens
  primer_bind 1..18: upstream amplification primer 99-6574 for SEQ 3581,
caaagggaaagaaagcag

SEQ ID NO: 7516 - DNA, 18 bp, Homo Sapiens
  primer_bind 1..18: upstream amplification primer 99-6583 for SEQ 3582,
tgttgacgacagccattg

SEQ ID NO: 7517 - DNA, 20 bp, Homo Sapiens
  primer_bind 1..20: upstream amplification primer 99-6591 for SEQ 3583,
cttttcagctacatacatac

SEQ ID NO: 7518 - DNA, 19 bp, Homo Sapiens
  primer_bind 1..19: upstream amplification primer 99-6597 for SEQ 3584,
gatcaatagaacatgggtg

SEQ ID NO: 7519 - DNA, 18 bp, Homo Sapiens
  primer_bind 1..18: upstream amplification primer 99-6603 for SEQ 3585,
tggaagggaaggaaaaag

SEQ ID NO: 7520 - DNA, 19 bp, Homo Sapiens
  primer_bind 1..19: upstream amplification primer 99-6707 for SEQ 3586,
cagttctgccacttacttc

SEQ ID NO: 7521 - DNA, 19 bp, Homo Sapiens
  primer_bind 1..19: upstream amplification primer 99-6720 for SEQ 3587,
ggggcaaaagatataaagg

SEQ ID NO: 7522 - DNA, 19 bp, Homo Sapiens
  primer_bind 1..19: upstream amplification primer 99-6809 for SEQ 3588,
aaatagaccttttgccaac

SEQ ID NO: 7523 - DNA, 19 bp, Homo Sapiens
  primer_bind 1..19: upstream amplification primer 99-6834 for SEQ 3589,
ccccctaaattcaaatcac

SEQ ID NO: 7524 - DNA, 20 bp, Homo Sapiens
  primer_bind 1..20: upstream amplification primer 99-6837 for SEQ 3590,
gatattgggatatgccttac

SEQ ID NO: 7525 - DNA, 18 bp, Homo Sapiens
  primer_bind 1..18: upstream amplification primer 99-6878 for SEQ 3591,
aacttcctaaaaccccac

SEQ ID NO: 7526 - DNA, 18 bp, Homo Sapiens
  primer_bind 1..18: upstream amplification primer 99-6888 for SEQ 3592,
aatcataccacccctatc

SEQ ID NO: 7527 - DNA, 19 bp, Homo Sapiens
  primer_bind 1..19: upstream amplification primer 99-6919 for SEQ 3593,
caaagcaatgcctcaaaac

SEQ ID NO: 7528 - DNA, 19 bp, Homo Sapiens
  primer_bind 1..19: upstream amplification primer 99-6922 for SEQ 3594,
tattcaggaatcaacagac

SEQ ID NO: 7529 - DNA, 18 bp, Homo Sapiens
  primer_bind 1..18: upstream amplification primer 99-6974 for SEQ 3595,
cattgttcctccttgctc

SEQ ID NO: 7530 - DNA, 18 bp, Homo Sapiens
  primer_bind 1..18: upstream amplification primer 99-6978 for SEQ 3596,
cagccatagatagaggac

SEQ ID NO: 7531 - DNA, 18 bp, Homo Sapiens
  primer_bind 1..18: upstream amplification primer 99-6984 for SEQ 3597,
aagtctactgggttctgg

SEQ ID NO: 7532 - DNA, 18 bp, Homo Sapiens
  primer_bind 1..18: upstream amplification primer 99-6998 for SEQ 3598,
ttacaaagccccattgag

SEQ ID NO: 7533 - DNA, 18 bp, Homo Sapiens
  primer_bind 1..18: upstream amplification primer 99-7032 for SEQ 3599,
acttaactctgtgacctg

SEQ ID NO: 7534 - DNA, 18 bp, Homo Sapiens
  primer_bind 1..18: upstream amplification primer 99-7048 for SEQ 3600,
cccctgaaatctaacatc

SEQ ID NO: 7535 - DNA, 19 bp, Homo Sapiens
  primer_bind 1..19: upstream amplification primer 99-7060 for SEQ 3601,
cctctccaattcattttcc

SEQ ID NO: 7536 - DNA, 18 bp, Homo Sapiens
  primer_bind 1..18: upstream amplification primer 99-7086 for SEQ 3602,
ctggcttcaaaagaacac

SEQ ID NO: 7537 - DNA, 21 bp, Homo Sapiens
  primer_bind 1..21: upstream amplification primer 99-7117 for SEQ 3603,
catgtttacctgtgatttgcc

SEQ ID NO: 7538 - DNA, 20 bp, Homo Sapiens
  primer_bind 1..20: upstream amplification primer 99-7203 for SEQ 3604,
tcttcatgtgattctttgag

SEQ ID NO: 7539 - DNA, 18 bp, Homo Sapiens
  primer_bind 1..18: upstream amplification primer 99-7268 for SEQ 3605,
ccttagttctcaggcatc

SEQ ID NO: 7540 - DNA, 19 bp, Homo Sapiens
  primer_bind 1..19: upstream amplification primer 99-7281 for SEQ 3606,
ctcaaaccttctcccaaac

SEQ ID NO: 7541 - DNA, 18 bp, Homo Sapiens
  primer_bind 1..18: upstream amplification primer 99-7282 for SEQ 3607,
tgaggaggatatagggag

SEQ ID NO: 7542 - DNA, 18 bp, Homo Sapiens
  primer_bind 1..18: upstream amplification primer 99-7296 for SEQ 3608,
atccccctgattcctaag

SEQ ID NO: 7543 - DNA, 20 bp, Homo Sapiens
  primer_bind 1..20: upstream amplification primer 99-7344 for SEQ 3609,
atctacaacaggactttttg

SEQ ID NO: 7544 - DNA, 18 bp, Homo Sapiens
  primer_bind 1..18: upstream amplification primer 99-7377 for SEQ 3610,
cttcatcctttttcctcc

SEQ ID NO: 7545 - DNA, 19 bp, Homo Sapiens
  primer_bind 1..19: upstream amplification primer 99-7394 for SEQ 3611,
acaagtgaaccccagagag

SEQ ID NO: 7546 - DNA, 19 bp, Homo Sapiens
  primer_bind 1..19: upstream amplification primer 99-7412 for SEQ 3612,
tttagtgagggtttatagg

SEQ ID NO: 7547 - DNA, 18 bp, Homo Sapiens
  primer_bind 1..18: upstream amplification primer 99-7422 for SEQ 3613,
agcaaagcgaaaagagcc

SEQ ID NO: 7548 - DNA, 19 bp, Homo Sapiens
  primer_bind 1..19: upstream amplification primer 99-7430 for SEQ 3614,
atattgcccgtttaagttg

SEQ ID NO: 7549 - DNA, 19 bp, Homo Sapiens
  primer_bind 1..19: upstream amplification primer 99-7442 for SEQ 3615,
actgattatctgtacgttg

SEQ ID NO: 7550 - DNA, 18 bp, Homo Sapiens
  primer_bind 1..18: upstream amplification primer 99-7481 for SEQ 3616,
cgtaggtgtgagagaaac

SEQ ID NO: 7551 - DNA, 18 bp, Homo Sapiens
  primer_bind 1..18: upstream amplification primer 99-7696 for SEQ 3617,
ctaactctaaactctggg

SEQ ID NO: 7552 - DNA, 18 bp, Homo Sapiens
  primer_bind 1..18: upstream amplification primer 99-7702 for SEQ 3618,
atcaggggttttggtgag

SEQ ID NO: 7553 - DNA, 18 bp, Homo Sapiens
  primer_bind 1..18: upstream amplification primer 99-7772 for SEQ 3619,
tatgccatgcaaggagac

SEQ ID NO: 7554 - DNA, 18 bp, Homo Sapiens
  primer_bind 1..18: upstream amplification primer 99-7815 for SEQ 3620,
gcctgtttatattccctg

SEQ ID NO: 7555 - DNA, 19 bp, Homo Sapiens
  primer_bind 1..19: upstream amplification primer 99-7818 for SEQ 3621,
tccccttctctctaacctc

SEQ ID NO: 7556 - DNA, 21 bp, Homo Sapiens
  primer_bind 1..21: upstream amplification primer 99-7860 for SEQ 3622,
gtctttcagtataaaacaacc

SEQ ID NO: 7557 - DNA, 18 bp, Homo Sapiens
  primer_bind 1..18: upstream amplification primer 99-7886 for SEQ 3623,
ctttctctcgtctctctc

SEQ ID NO: 7558 - DNA, 19 bp, Homo Sapiens
  primer_bind 1..19: upstream amplification primer 99-7944 for SEQ 3624,
tgagacaccatccaagtcc

SEQ ID NO: 7559 - DNA, 19 bp, Homo Sapiens
  primer_bind 1..19: upstream amplification primer 99-7945 for SEQ 3625,
gtatctccttcttcttgtc

SEQ ID NO: 7560 - DNA, 20 bp, Homo Sapiens
  primer_bind 1..20: upstream amplification primer 99-7976 for SEQ 3626,
atttcctattgttgtttgcc

SEQ ID NO: 7561 - DNA, 19 bp, Homo Sapiens
  primer_bind 1..19: upstream amplification primer 99-8000 for SEQ 3627,
atgtttgctcccccttctg

SEQ ID NO: 7562 - DNA, 18 bp, Homo Sapiens
  primer_bind 1..18: upstream amplification primer 99-8006 for SEQ 3628,
gcacgattgatgcagaac

SEQ ID NO: 7563 - DNA, 18 bp, Homo Sapiens
  primer_bind 1..18: upstream amplification primer 99-8038 for SEQ 3629,
tgagaggaaggaggttag

SEQ ID NO: 7564 - DNA, 19 bp, Homo Sapiens
  primer_bind 1..19: upstream amplification primer 99-8055 for SEQ 3630,
ccagaaagtcatcagaatg

SEQ ID NO: 7565 - DNA, 19 bp, Homo Sapiens
  primer_bind 1..19: upstream amplification primer 99-8059 for SEQ 3631,
cactgagttcaaaaaagcc

SEQ ID NO: 7566 - DNA, 18 bp, Homo Sapiens
  primer_bind 1..18: upstream amplification primer 99-8061 for SEQ 3632,
gtctgctgtaaaaggatg

SEQ ID NO: 7567 - DNA, 20 bp, Homo Sapiens
  primer_bind 1..20: upstream amplification primer 99-8109 for SEQ 3633,
gacatttcttcctttatgcc

SEQ ID NO: 7568 - DNA, 18 bp, Homo Sapiens
  primer_bind 1..18: upstream amplification primer 99-8115 for SEQ 3634,
agatttaccagaccccag

SEQ ID NO: 7569 - DNA, 18 bp, Homo Sapiens
  primer_bind 1..18: upstream amplification primer 99-8166 for SEQ 3635,
cttcatcctttttcctcc

SEQ ID NO: 7570 - DNA, 19 bp, Homo Sapiens
  primer_bind 1..19: upstream amplification primer 99-8226 for SEQ 3636,
cccaaacttttttgaacac

SEQ ID NO: 7571 - DNA, 20 bp, Homo Sapiens
  primer_bind 1..20: upstream amplification primer 99-8232 for SEQ 3637,
ggtagaaagaatgagatgag

SEQ ID NO: 7572 - DNA, 19 bp, Homo Sapiens
  primer_bind 1..19: upstream amplification primer 99-824 for SEQ 3638,
ctcataaatcaagttgccc

SEQ ID NO: 7573 - DNA, 19 bp, Homo Sapiens
  primer_bind 1..19: upstream amplification primer 99-8274 for SEQ 3639,
ggaatagagtagattcagc

SEQ ID NO: 7574 - DNA, 20 bp, Homo Sapiens
  primer_bind 1..20: upstream amplification primer 99-8359 for SEQ 3640,
gttgtttttactagggtcag

SEQ ID NO: 7575 - DNA, 20 bp, Homo Sapiens
  primer_bind 1..20: upstream amplification primer 99-8630 for SEQ 3641,
cttacagttgaaaagtgagg

SEQ ID NO: 7576 - DNA, 20 bp, Homo Sapiens
  primer_bind 1..20: upstream amplification primer 99-8659 for SEQ 3642,
gaccttaaaaagatggtttg

SEQ ID NO: 7577 - DNA, 19 bp, Homo Sapiens
  primer_bind 1..19: upstream amplification primer 99-8679 for SEQ 3643,
ttcaatttctctcagttcc

SEQ ID NO: 7578 - DNA, 18 bp, Homo Sapiens
  primer_bind 1..18: upstream amplification primer 99-8690 for SEQ 3644,
atcacagagagtgccatc

SEQ ID NO: 7579 - DNA, 20 bp, Homo Sapiens
  primer_bind 1..20: upstream amplification primer 99-8751 for SEQ 3645,
tcccaacacccactctctac

SEQ ID NO: 7580 - DNA, 18 bp, Homo Sapiens
  primer_bind 1..18: upstream amplification primer 99-8795 for SEQ 3646,
aaatgctctgttatgccc

SEQ ID NO: 7581 - DNA, 19 bp, Homo Sapiens
  primer_bind 1..19: upstream amplification primer 99-882 for SEQ 3647,
agttgatgtagaaatctgg

SEQ ID NO: 7582 - DNA, 20 bp, Homo Sapiens
  primer_bind 1..20: upstream amplification primer 99-887 for SEQ 3648,
gtttttgtcttctacttgtc

SEQ ID NO: 7583 - DNA, 20 bp, Homo Sapiens
  primer_bind 1..20: upstream amplification primer 99-8875 for SEQ 3649,
atcacgggtgtgagccattc

SEQ ID NO: 7584 - DNA, 19 bp, Homo Sapiens
  primer_bind 1..19: upstream amplification primer 99-892 for SEQ 3650,
tgaggcagcacatagacac

SEQ ID NO: 7585 - DNA, 18 bp, Homo Sapiens
  primer_bind 1..18: upstream amplification primer 99-8936 for SEQ 3651,
aaactacagaccataccc

SEQ ID NO: 7586 - DNA, 20 bp, Homo Sapiens
  primer_bind 1..20: upstream amplification primer 99-8952 for SEQ 3652,
ctaaaaacctcatttcccag

SEQ ID NO: 7587 - DNA, 18 bp, Homo Sapiens
  primer_bind 1..18: upstream amplification primer 99-896 for SEQ 3653,
gtttggcttctccatctc

SEQ ID NO: 7588 - DNA, 20 bp, Homo Sapiens
  primer_bind 1..20: upstream amplification primer 99-899 for SEQ 3654,
ggtgtatctaggcatttatc

SEQ ID NO: 7589 - DNA, 21 bp, Homo Sapiens
  primer_bind 1..21: upstream amplification primer 99-9072 for SEQ 3655,
ggcaaaatgaggttctactac

SEQ ID NO: 7590 - DNA, 19 bp, Homo Sapiens
  primer_bind 1..19: upstream amplification primer 99-9076 for SEQ 3656,
tgtttgtggaagaatagag

SEQ ID NO: 7591 - DNA, 18 bp, Homo Sapiens
  primer_bind 1..18: upstream amplification primer 99-9077 for SEQ 3657,
ttctgcaagaacagacac

SEQ ID NO: 7592 - DNA, 20 bp, Homo Sapiens
  primer_bind 1..20: upstream amplification primer 99-9089 for SEQ 3658,
cagataaaaataaaggtgcc

SEQ ID NO: 7593 - DNA, 21 bp, Homo Sapiens
  primer_bind 1..21: upstream amplification primer 99-9113 for SEQ 3659,
acagacaggtgataggtaaag

SEQ ID NO: 7594 - DNA, 18 bp, Homo Sapiens
  primer_bind 1..18: upstream amplification primer 99-9145 for SEQ 3660,
ccatccctactctaatac

SEQ ID NO: 7595 - DNA, 18 bp, Homo Sapiens
  primer_bind 1..18: upstream amplification primer 99-9164 for SEQ 3661,
tgtaggcttcaaggaagg

SEQ ID NO: 7596 - DNA, 19 bp, Homo Sapiens
  primer_bind 1..19: upstream amplification primer 99-9308 for SEQ 3662,
ccttacttgtctgttttcc

SEQ ID NO: 7597 - DNA, 21 bp, Homo Sapiens
  primer_bind 1..21: upstream amplification primer 99-9316 for SEQ 3663,
gcttttaataagacatacacc

SEQ ID NO: 7598 - DNA, 18 bp, Homo Sapiens
  primer_bind 1..18: upstream amplification primer 99-9343 for SEQ 3664,
gtgaaagtatcaggtagg

SEQ ID NO: 7599 - DNA, 20 bp, Homo Sapiens
  primer_bind 1..20: upstream amplification primer 99-9362 for SEQ 3665,
tgcctacaggtcaagggttc

SEQ ID NO: 7600 - DNA, 20 bp, Homo Sapiens
  primer_bind 1..20: upstream amplification primer 99-9363 for SEQ 3666,
gtgacccatttttctaattc

SEQ ID NO: 7601 - DNA, 21 bp, Homo Sapiens
  primer_bind 1..21: upstream amplification primer 99-9375 for SEQ 3667,
gaggattaaacattgtttgtc

SEQ ID NO: 7602 - DNA, 18 bp, Homo Sapiens
  primer_bind 1..18: upstream amplification primer 99-9380 for SEQ 3668,
caacagccaccatttacc

SEQ ID NO: 7603 - DNA, 19 bp, Homo Sapiens
  primer_bind 1..19: upstream amplification primer 99-9607 for SEQ 3669,
tttgaagttggatggatgg

SEQ ID NO: 7604 - DNA, 18 bp, Homo Sapiens
  primer_bind 1..18: upstream amplification primer 99-9620 for SEQ 3670,
tctaattccaagcccagc

SEQ ID NO: 7605 - DNA, 21 bp, Homo Sapiens
  primer_bind 1..21: upstream amplification primer 99-9623 for SEQ 3671,
tctgttctgctgacttctggg

SEQ ID NO: 7606 - DNA, 20 bp, Homo Sapiens
  primer_bind 1..20: upstream amplification primer 99-9633 for SEQ 3672,
ctgacattctggaaattcac

SEQ ID NO: 7607 - DNA, 18 bp, Homo Sapiens
  primer_bind 1..18: upstream amplification primer 99-9636 for SEQ 3673,
tggttaaagatgaggggc

SEQ ID NO: 7608 - DNA, 20 bp, Homo Sapiens
  primer_bind 1..20: upstream amplification primer 99-9658 for SEQ 3674,
aagggggctctacctaagtg

SEQ ID NO: 7609 - DNA, 20 bp, Homo Sapiens
  primer_bind 1..20: upstream amplification primer 99-9662 for SEQ 3675,
aagaagtggggtgggaatgg

SEQ ID NO: 7610 - DNA, 19 bp, Homo Sapiens
  primer_bind 1..19: upstream amplification primer 99-9666 for SEQ 3676,
tttggctcgctcttttatg

SEQ ID NO: 7611 - DNA, 18 bp, Homo Sapiens
  primer_bind 1..18: upstream amplification primer 99-9668 for SEQ 3677,
caatgaacttcaggcatc

SEQ ID NO: 7612 - DNA, 20 bp, Homo Sapiens
  primer_bind 1..20: upstream amplification primer 99-9680 for SEQ 3678,
ctgtataaaaaagggaactg

SEQ ID NO: 7613 - DNA, 20 bp, Homo Sapiens
  primer_bind 1..20: upstream amplification primer 99-9696 for SEQ 3679,
cctgtccttcataacccttg

SEQ ID NO: 7614 - DNA, 19 bp, Homo Sapiens
  primer_bind 1..19: upstream amplification primer 99-9697 for SEQ 3680,
ccagtttgctactaacaag

SEQ ID NO: 7615 - DNA, 19 bp, Homo Sapiens
  primer_bind 1..19: upstream amplification primer 99-9700 for SEQ 3681,
tagtctgaaatatgatccc

SEQ ID NO: 7616 - DNA, 19 bp, Homo Sapiens
  primer_bind 1..19: upstream amplification primer 99-9704 for SEQ 3682,
tattaaggtctgtatgtgg

SEQ ID NO: 7617 - DNA, 19 bp, Homo Sapiens
  primer_bind 1..19: upstream amplification primer 99-9706 for SEQ 3683,
gggagaacataagagaaag

SEQ ID NO: 7618 - DNA, 19 bp, Homo Sapiens
  primer_bind 1..19: upstream amplification primer 99-9709 for SEQ 3684,
tgagccttacactattttc

SEQ ID NO: 7619 - DNA, 20 bp, Homo Sapiens
  primer_bind 1..20: upstream amplification primer 99-9710 for SEQ 3685,
gagctttcaaacttctctac

SEQ ID NO: 7620 - DNA, 19 bp, Homo Sapiens
  primer_bind 1..19: upstream amplification primer 99-9714 for SEQ 3686,
cttaaccattaccctatcc

SEQ ID NO: 7621 - DNA, 18 bp, Homo Sapiens
  primer_bind 1..18: upstream amplification primer 99-9717 for SEQ 3687,
ggggagagaataacttgg

SEQ ID NO: 7622 - DNA, 20 bp, Homo Sapiens
  primer_bind 1..20: upstream amplification primer 99-9726 for SEQ 3688,
ttgaggggctgggaacatag

SEQ ID NO: 7623 - DNA, 18 bp, Homo Sapiens
  primer_bind 1..18: upstream amplification primer 99-974 for SEQ 3689,
gtagcctgacaatgaacc

SEQ ID NO: 7624 - DNA, 20 bp, Homo Sapiens
  primer_bind 1..20: upstream amplification primer 99-9745 for SEQ 3690,
tatggaagcactgtcctggc

SEQ ID NO: 7625 - DNA, 21 bp, Homo Sapiens
  primer_bind 1..21: upstream amplification primer 99-9751 for SEQ 3691,
cctggaggaagaaaggtcaag

SEQ ID NO: 7626 - DNA, 19 bp, Homo Sapiens
  primer_bind 1..19: upstream amplification primer 99-9765 for SEQ 3692,
gaaggagaaatcacatgag

SEQ ID NO: 7627 - DNA, 18 bp, Homo Sapiens
  primer_bind 1..18: upstream amplification primer 99-9774 for SEQ 3693,
tcaacgattggcactgtc

SEQ ID NO: 7628 - DNA, 18 bp, Homo Sapiens
  primer_bind 1..18: upstream amplification primer 99-9778 for SEQ 3694,
acacatcatccagtctcc

SEQ ID NO: 7629 - DNA, 19 bp, Homo Sapiens
  primer_bind 1..19: upstream amplification primer 99-9781 for SEQ 3695,
aggcagcttctaggcaatg

SEQ ID NO: 7630 - DNA, 18 bp, Homo Sapiens
  primer_bind 1..18: upstream amplification primer 99-9785 for SEQ 3696,
gaatctcgggagtttgtg

SEQ ID NO: 7631 - DNA, 19 bp, Homo Sapiens
  primer_bind 1..19: upstream amplification primer 99-9810 for SEQ 3697,
catcaatgtgtccactttc

SEQ ID NO: 7632 - DNA, 19 bp, Homo Sapiens
  primer_bind 1..19: upstream amplification primer 99-9811 for SEQ 3698,
tgtccattcaatttaccag

SEQ ID NO: 7633 - DNA, 20 bp, Homo Sapiens
  primer_bind 1..20: upstream amplification primer 99-9820 for SEQ 3699,
tttgtgtcctgtcactcccc

SEQ ID NO: 7634 - DNA, 21 bp, Homo Sapiens
  primer_bind 1..21: upstream amplification primer 99-9822 for SEQ 3700,
tacattcctccttccaacaac

SEQ ID NO: 7635 - DNA, 18 bp, Homo Sapiens
  primer_bind 1..18: upstream amplification primer 99-9829 for SEQ 3701,
agtttgtctgctggaagg

SEQ ID NO: 7636 - DNA, 18 bp, Homo Sapiens
  primer_bind 1..18: upstream amplification primer 99-983 for SEQ 3702,
acagaggggagaattgag

SEQ ID NO: 7637 - DNA, 20 bp, Homo Sapiens
  primer_bind 1..20: upstream amplification primer 99-9832 for SEQ 3703,
cataaacctacaagtattcc

SEQ ID NO: 7638 - DNA, 20 bp, Homo Sapiens
  primer_bind 1..20: upstream amplification primer 99-9833 for SEQ 3704,
ctctgaaatatcctaactac

SEQ ID NO: 7639 - DNA, 19 bp, Homo Sapiens
  primer_bind 1..19: upstream amplification primer 99-9835 for SEQ 3705,
aatatagcagcaatctctc

SEQ ID NO: 7640 - DNA, 18 bp, Homo Sapiens
  primer_bind 1..18: upstream amplification primer 99-9837 for SEQ 3706,
gctcatacggtgaatcag

SEQ ID NO: 7641 - DNA, 18 bp, Homo Sapiens
  primer_bind 1..18: upstream amplification primer 99-9839 for SEQ 3707,
tcagagtccaaccattag

SEQ ID NO: 7642 - DNA, 21 bp, Homo Sapiens
  primer_bind 1..21: upstream amplification primer 99-9840 for SEQ 3708,
ctctttcttcctttcattatc

SEQ ID NO: 7643 - DNA, 18 bp, Homo Sapiens
  primer_bind 1..18: upstream amplification primer 99-9847 for SEQ 3709,
gaatagagaaagagaggg

SEQ ID NO: 7644 - DNA, 21 bp, Homo Sapiens
  primer_bind 1..21: upstream amplification primer 99-9849 for SEQ 3710,
caactacctaaacatctatac

SEQ ID NO: 7645 - DNA, 19 bp, Homo Sapiens
  primer_bind 1..19: upstream amplification primer 99-9852 for SEQ 3711,
gggtctactttatgaaagg

SEQ ID NO: 7646 - DNA, 21 bp, Homo Sapiens
  primer_bind 1..21: upstream amplification primer 99-9854 for SEQ 3712,
gcagagaaagggtttatattc

SEQ ID NO: 7647 - DNA, 18 bp, Homo Sapiens
  primer_bind 1..18: upstream amplification primer 99-9856 for SEQ 3713,
atagacgctactcactgg

SEQ ID NO: 7648 - DNA, 19 bp, Homo Sapiens
  primer_bind 1..19: upstream amplification primer 99-9859 for SEQ 3714,
tatcaaatggttatcaggg

SEQ ID NO: 7649 - DNA, 20 bp, Homo Sapiens
  primer_bind 1..20: upstream amplification primer 99-9866 for SEQ 3715,
taggtgggaagggatggatg

SEQ ID NO: 7650 - DNA, 18 bp, Homo Sapiens
  primer_bind 1..18: upstream amplification primer 99-990 for SEQ 3716,
cttggctttatgaaggtg

SEQ ID NO: 7651 - DNA, 20 bp, Homo Sapiens
  primer_bind 1..20: upstream amplification primer 99-9906 for SEQ 3717,
caaaatctatttgtagaggg

SEQ ID NO: 7652 - DNA, 20 bp, Homo Sapiens
  primer_bind 1..20: upstream amplification primer 99-9908 for SEQ 3718,
atctaacgctcctgggtctc

SEQ ID NO: 7653 - DNA, 20 bp, Homo Sapiens
  primer_bind 1..20: upstream amplification primer 99-991 for SEQ 3719,
cataatttctcattggcagg

SEQ ID NO: 7654 - DNA, 19 bp, Homo Sapiens
  primer_bind 1..19: upstream amplification primer 99-9915 for SEQ 3720,
cctaactatgtaaggactc

SEQ ID NO: 7655 - DNA, 20 bp, Homo Sapiens
  primer_bind 1..20: upstream amplification primer 99-9920 for SEQ 3721,
gttcaaagaccagtttcttc

SEQ ID NO: 7656 - DNA, 19 bp, Homo Sapiens
  primer_bind 1..19: upstream amplification primer 99-9921 for SEQ 3722,
agtgttgtttgtatgagtg

SEQ ID NO: 7657 - DNA, 19 bp, Homo Sapiens
  primer_bind 1..19: upstream amplification primer 99-9922 for SEQ 3723,
gcattctagttaaaacctc

SEQ ID NO: 7658 - DNA, 18 bp, Homo Sapiens
  primer_bind 1..18: upstream amplification primer 99-9926 for SEQ 3724,
aaccttcgagatccattc

SEQ ID NO: 7659 - DNA, 19 bp, Homo Sapiens
  primer_bind 1..19: upstream amplification primer 99-9928 for SEQ 3725,
tcctgtggtttatagttag

SEQ ID NO: 7660 - DNA, 20 bp, Homo Sapiens
  primer_bind 1..20: upstream amplification primer 99-9929 for SEQ 3726,
gctatcttttctttgcagac

SEQ ID NO: 7661 - DNA, 20 bp, Homo Sapiens
  primer_bind 1..20: upstream amplification primer 99-9935 for SEQ 3727,
tgctgaccgcagtcactttc

SEQ ID NO: 7662 - DNA, 19 bp, Homo Sapiens
  primer_bind 1..19: upstream amplification primer 99-9941 for SEQ 3728,
caaagctcagttttgaagg

SEQ ID NO: 7663 - DNA, 19 bp, Homo Sapiens
  primer_bind 1..19: upstream amplification primer 99-995 for SEQ 3729,
atcccccgtgaatgctatg

SEQ ID NO: 7664 - DNA, 19 bp, Homo Sapiens
  primer_bind 1..19: upstream amplification primer 99-996 for SEQ 3730,
tgtgggttacttttttctc

SEQ ID NO: 7665 - DNA, 21 bp, Homo Sapiens
  primer_bind 1..21: upstream amplification primer 99-9986 for SEQ 3731,
ttgaatggcggtagtatgtgg

SEQ ID NO: 7666 - DNA, 21 bp, Homo Sapiens
  primer_bind 1..21: upstream amplification primer 99-9988 for SEQ 3732,
gatgaagtataacgagtattg

SEQ ID NO: 7667 - DNA, 20 bp, Homo Sapiens
  primer_bind 1..20: upstream amplification primer 99-9994 for SEQ 3733,
gtgttccctatgtgtttatc

SEQ ID NO: 7668 - DNA, 19 bp, Homo Sapiens
  primer_bind 1..19: upstream amplification primer 99-9995 for SEQ 3734,
actgccactactgatgtcc

SEQ ID NO: 7669 - DNA, 19 bp, Homo Sapiens
  primer_bind 1..19: upstream amplification primer 99-10069 for SEQ 3735,
gcaacaataaaagtagtgg

SEQ ID NO: 7670 - DNA, 21 bp, Homo Sapiens
  primer_bind 1..21: upstream amplification primer 99-10074 for SEQ 3736,
gtttttgtttgttttagaccc

SEQ ID NO: 7671 - DNA, 21 bp, Homo Sapiens
  primer_bind 1..21: upstream amplification primer 99-10129 for SEQ 3737,
ctttaagagccattttgaaac

SEQ ID NO: 7672 - DNA, 20 bp, Homo Sapiens
  primer_bind 1..20: upstream amplification primer 99-10198 for SEQ 3738,
cagatgtattccagtaaaag

SEQ ID NO: 7673 - DNA, 20 bp, Homo Sapiens
  primer_bind 1..20: upstream amplification primer 99-10306 for SEQ 3739,
gtagtaaatagagtaagctg

SEQ ID NO: 7674 - DNA, 20 bp, Homo Sapiens
  primer_bind 1..20: upstream amplification primer 99-10307 for SEQ 3740,
gagatacatacttacaaggc

SEQ ID NO: 7675 - DNA, 19 bp, Homo Sapiens
  primer_bind 1..19: upstream amplification primer 99-10326 for SEQ 3741,
attgatggttgttggaatg

SEQ ID NO: 7676 - DNA, 20 bp, Homo Sapiens
  primer_bind 1..20: upstream amplification primer 99-10393 for SEQ 3742,
ccacacagcagcagtaactc

SEQ ID NO: 7677 - DNA, 20 bp, Homo Sapiens
  primer_bind 1..20: upstream amplification primer 99-10685 for SEQ 3743,
ctttaggtttcttttggcag

SEQ ID NO: 7678 - DNA, 21 bp, Homo Sapiens
  primer_bind 1..21: upstream amplification primer 99-10857 for SEQ 3744,
cacacttccacaaattatttc

SEQ ID NO: 7679 - DNA, 18 bp, Homo Sapiens
  primer_bind 1..18: upstream amplification primer 99-10948 for SEQ 3745,
atatcccaattccagccg

SEQ ID NO: 7680 - DNA, 21 bp, Homo Sapiens
  primer_bind 1..21: upstream amplification primer 99-11104 for SEQ 3746,
cagccactatggaataatatg

SEQ ID NO: 7681 - DNA, 19 bp, Homo Sapiens
  primer_bind 1..19: upstream amplification primer 99-11116 for SEQ 3747,
tgccatatttctctcatcc

SEQ ID NO: 7682 - DNA, 19 bp, Homo Sapiens
  primer_bind 1..19: upstream amplification primer 99-11117 for SEQ 3748,
gtcattaaaaagtgagcag

SEQ ID NO: 7683 - DNA, 21 bp, Homo Sapiens
  primer_bind 1..21: upstream amplification primer 99-11121 for SEQ 3749,
ctccctcaatatcattttgtc

SEQ ID NO: 7684 - DNA, 18 bp, Homo Sapiens
  primer_bind 1..18: upstream amplification primer 99-11124 for SEQ 3750,
ctcttaatcacactgggg

SEQ ID NO: 7685 - DNA, 19 bp, Homo Sapiens
  primer_bind 1..19: upstream amplification primer 99-11172 for SEQ 3751,
aattatactcccacctgcc

SEQ ID NO: 7686 - DNA, 18 bp, Homo Sapiens
  primer_bind 1..18: upstream amplification primer 99-11206 for SEQ 3752,
gtttacgttatcccgatg

SEQ ID NO: 7687 - DNA, 19 bp, Homo Sapiens
  primer_bind 1..19: upstream amplification primer 99-11303 for SEQ 3753,
ttgaatctgttccccgctc

SEQ ID NO: 7688 - DNA, 21 bp, Homo Sapiens
  primer_bind 1..21: upstream amplification primer 99-11307 for SEQ 3754,
catgcgtgttttttaggagtc

SEQ ID NO: 7689 - DNA, 21 bp, Homo Sapiens
  primer_bind 1..21: upstream amplification primer 99-11325 for SEQ 3755,
gctttcaaacttgctagaagg

SEQ ID NO: 7690 - DNA, 20 bp, Homo Sapiens
  primer_bind 1..20: upstream amplification primer 99-11365 for SEQ 3756,
taggcttcggctgacaacac

SEQ ID NO: 7691 - DNA, 21 bp, Homo Sapiens
  primer_bind 1..21: upstream amplification primer 99-11389 for SEQ 3757,
ggtttagacacagaatttggg

SEQ ID NO: 7692 - DNA, 20 bp, Homo Sapiens
  primer_bind 1..20: upstream amplification primer 99-11395 for SEQ 3758,
ggtgggataatggaattgtg

SEQ ID NO: 7693 - DNA, 21 bp, Homo Sapiens
  primer_bind 1..21: upstream amplification primer 99-11500 for SEQ 3759,
ctgtattcagaatgctacagg

SEQ ID NO: 7694 - DNA, 20 bp, Homo Sapiens
  primer_bind 1..20: upstream amplification primer 99-11571 for SEQ 3760,
cttcttgggattcttttcag

SEQ ID NO: 7695 - DNA, 20 bp, Homo Sapiens
  primer_bind 1..20: upstream amplification primer 99-11710 for SEQ 3761,
gttgtgaaaaacaactctcc

SEQ ID NO: 7696 - DNA, 18 bp, Homo Sapiens
  primer_bind 1..18: upstream amplification primer 99-1173 for SEQ 3762,
tggctttcgtgttgtttc

SEQ ID NO: 7697 - DNA, 20 bp, Homo Sapiens
  primer_bind 1..20: upstream amplification primer 99-11735 for SEQ 3763,
ctttatggattttgcttgtg

SEQ ID NO: 7698 - DNA, 21 bp, Homo Sapiens
  primer_bind 1..21: upstream amplification primer 99-11864 for SEQ 3764,
cttcactagcctccaaaaatc

SEQ ID NO: 7699 - DNA, 18 bp, Homo Sapiens
  primer_bind 1..18: upstream amplification primer 99-1187 for SEQ 3765,
acttcctctcacaccatc

SEQ ID NO: 7700 - DNA, 19 bp, Homo Sapiens
  primer_bind 1..19: upstream amplification primer 99-11872 for SEQ 3766,
agctctggtatcgacagac

SEQ ID NO: 7701 - DNA, 20 bp, Homo Sapiens
  primer_bind 1..20: upstream amplification primer 99-11878 for SEQ 3767,
cccttttgtcacatgaaaac

SEQ ID NO: 7702 - DNA, 20 bp, Homo Sapiens
  primer_bind 1..20: upstream amplification primer 99-11905 for SEQ 3768,
agcctgtgttggacctgaag

SEQ ID NO: 7703 - DNA, 20 bp, Homo Sapiens
  primer_bind 1..20: upstream amplification primer 99-11932 for SEQ 3769,
aactgccacttccacaccac

SEQ ID NO: 7704 - DNA, 19 bp, Homo Sapiens
  primer_bind 1..19: upstream amplification primer 99-11964 for SEQ 3770,
gttgctatcacaatggagg

SEQ ID NO: 7705 - DNA, 19 bp, Homo Sapiens
  primer_bind 1..19: upstream amplification primer 99-12164 for SEQ 3771,
aggtgttggtttagttttc

SEQ ID NO: 7706 - DNA, 19 bp, Homo Sapiens
  primer_bind 1..19: upstream amplification primer 99-12227 for SEQ 3772,
atgtattggtcacgaatag

SEQ ID NO: 7707 - DNA, 18 bp, Homo Sapiens
  primer_bind 1..18: upstream amplification primer 99-12417 for SEQ 3773,
ggacacctgacacttaac

SEQ ID NO: 7708 - DNA, 20 bp, Homo Sapiens
  primer_bind 1..20: upstream amplification primer 99-12459 for SEQ 3774,
agaacgcagatgatgacccc

SEQ ID NO: 7709 - DNA, 19 bp, Homo Sapiens
  primer_bind 1..19: upstream amplification primer 99-12521 for SEQ 3775,
tcaaccacgggatgctttc

SEQ ID NO: 7710 - DNA, 18 bp, Homo Sapiens
  primer_bind 1..18: upstream amplification primer 99-12569 for SEQ 3776,
ctaacaccaccgatgatg

SEQ ID NO: 7711 - DNA, 21 bp, Homo Sapiens
  primer_bind 1..21: upstream amplification primer 99-1298 for SEQ 3777,
caggatattttccaaacattc

SEQ ID NO: 7712 - DNA, 19 bp, Homo Sapiens
  primer_bind 1..19: upstream amplification primer 99-1315 for SEQ 3778,
aagcatttaaaaaggggac

SEQ ID NO: 7713 - DNA, 21 bp, Homo Sapiens
  primer_bind 1..21: upstream amplification primer 99-13154 for SEQ 3779,
ttctctctaggttcacagatg

SEQ ID NO: 7714 - DNA, 21 bp, Homo Sapiens
  primer_bind 1..21: upstream amplification primer 99-13155 for SEQ 3780,
gataaaatgaactttgccttg

SEQ ID NO: 7715 - DNA, 19 bp, Homo Sapiens
  primer_bind 1..19: upstream amplification primer 99-13249 for SEQ 3781,
ttcagggcttttctgtggg

SEQ ID NO: 7716 - DNA, 19 bp, Homo Sapiens
  primer_bind 1..19: upstream amplification primer 99-13794 for SEQ 3782,
aggagctggttgtacttgg

SEQ ID NO: 7717 - DNA, 20 bp, Homo Sapiens
  primer_bind 1..20: upstream amplification primer 99-14899 for SEQ 3783,
tgggagagaagcagatgtgg

SEQ ID NO: 7718 - DNA, 18 bp, Homo Sapiens
  primer_bind 1..18: upstream amplification primer 99-16351 for SEQ 3784,
tttatgctggtggtttgc

SEQ ID NO: 7719 - DNA, 19 bp, Homo Sapiens
  primer_bind 1..19: upstream amplification primer 99-16436 for SEQ 3785,
gattgaatggggaacttgg

SEQ ID NO: 7720 - DNA, 20 bp, Homo Sapiens
  primer_bind 1..20: upstream amplification primer 99-16753 for SEQ 3786,
gacaaaagcatggatcaaag

SEQ ID NO: 7721 - DNA, 20 bp, Homo Sapiens
  primer_bind 1..20: upstream amplification primer 99-1807 for SEQ 3787,
ctgccattaattctagcttc

SEQ ID NO: 7722 - DNA, 19 bp, Homo Sapiens
  primer_bind 1..19: upstream amplification primer 99-19032 for SEQ 3788,
agttcttctctagcagccc

SEQ ID NO: 7723 - DNA, 19 bp, Homo Sapiens
  primer_bind 1..19: upstream amplification primer 99-19212 for SEQ 3789,
tatgaccgtggagttggag

SEQ ID NO: 7724 - DNA, 20 bp, Homo Sapiens
  primer_bind 1..20: upstream amplification primer 99-19273 for SEQ 3790,
tgccctctctctgtgtttcc

SEQ ID NO: 7725 - DNA, 21 bp, Homo Sapiens
  primer_bind 1..21: upstream amplification primer 99-19279 for SEQ 3791,
gcataagaaaactgaaggggg

SEQ ID NO: 7726 - DNA, 20 bp, Homo Sapiens
  primer_bind 1..20: upstream amplification primer 99-19541 for SEQ 3792,
gaatatgtaactgaatggtg

SEQ ID NO: 7727 - DNA, 21 bp, Homo Sapiens
  primer_bind 1..21: upstream amplification primer 99-19552 for SEQ 3793,
ctctcaatgttatcacactcc

SEQ ID NO: 7728 - DNA, 19 bp, Homo Sapiens
  primer_bind 1..19: upstream amplification primer 99-21051 for SEQ 3794,
aaaacatttacatcagccc

SEQ ID NO: 7729 - DNA, 19 bp, Homo Sapiens
  primer_bind 1..19: upstream amplification primer 99-21246 for SEQ 3795,
ggtttggtactgattactg

SEQ ID NO: 7730 - DNA, 19 bp, Homo Sapiens
  primer_bind 1..19: upstream amplification primer 99-21387 for SEQ 3796,
tgccatcaggtcaggaatg

SEQ ID NO: 7731 - DNA, 18 bp, Homo Sapiens
  primer_bind 1..18: upstream amplification primer 99-21407 for SEQ 3797,
tgtgataggtactagcgg

SEQ ID NO: 7732 - DNA, 21 bp, Homo Sapiens
  primer_bind 1..21: upstream amplification primer 99-21418 for SEQ 3798,
ctgtgaaataactactgaagg

SEQ ID NO: 7733 - DNA, 20 bp, Homo Sapiens
  primer_bind 1..20: upstream amplification primer 99-21419 for SEQ 3799,
atcctgggctcagtgacaag

SEQ ID NO: 7734 - DNA, 19 bp, Homo Sapiens
  primer_bind 1..19: upstream amplification primer 99-21430 for SEQ 3800,
acacaaaacaggtggcagg

SEQ ID NO: 7735 - DNA, 19 bp, Homo Sapiens
  primer_bind 1..19: upstream amplification primer 99-21435 for SEQ 3801,
ggaataggacaggaaactc

SEQ ID NO: 7736 - DNA, 21 bp, Homo Sapiens
  primer_bind 1..21: upstream amplification primer 99-21446 for SEQ 3802,
taaagccccaacaagctagtc

SEQ ID NO: 7737 - DNA, 20 bp, Homo Sapiens
  primer_bind 1..20: upstream amplification primer 99-21452 for SEQ 3803,
tctgattggctggctcgaag

SEQ ID NO: 7738 - DNA, 19 bp, Homo Sapiens
  primer_bind 1..19: upstream amplification primer 99-21488 for SEQ 3804,
gatcagaggatgaactttg

SEQ ID NO: 7739 - DNA, 21 bp, Homo Sapiens
  primer_bind 1..21: upstream amplification primer 99-21489 for SEQ 3805,
ttagcctttgtgtctccttag

SEQ ID NO: 7740 - DNA, 18 bp, Homo Sapiens
  primer_bind 1..18: upstream amplification primer 99-21496 for SEQ 3806,
ccgaccacaatactttcc

SEQ ID NO: 7741 - DNA, 19 bp, Homo Sapiens
  primer_bind 1..19: upstream amplification primer 99-21519 for SEQ 3807,
actctcctccaccatcatc

SEQ ID NO: 7742 - DNA, 18 bp, Homo Sapiens
  primer_bind 1..18: upstream amplification primer 99-21618 for SEQ 3808,
ttattggcgggtggaaac

SEQ ID NO: 7743 - DNA, 19 bp, Homo Sapiens
  primer_bind 1..19: upstream amplification primer 99-21725 for SEQ 3809,
tgagcagtgtcagtgacag

SEQ ID NO: 7744 - DNA, 18 bp, Homo Sapiens
  primer_bind 1..18: upstream amplification primer 99-21773 for SEQ 3810,
gagagagcaaaacccaag

SEQ ID NO: 7745 - DNA, 21 bp, Homo Sapiens
  primer_bind 1..21: upstream amplification primer 99-21781 for SEQ 3811,
gctgaagcaggtgaatgtacg

SEQ ID NO: 7746 - DNA, 19 bp, Homo Sapiens
  primer_bind 1..19: upstream amplification primer 99-21820 for SEQ 3812,
aaaatgattctctggtctc

SEQ ID NO: 7747 - DNA, 20 bp, Homo Sapiens
  primer_bind 1..20: upstream amplification primer 99-21822 for SEQ 3813,
gtatcactatcattactgcc

SEQ ID NO: 7748 - DNA, 20 bp, Homo Sapiens
  primer_bind 1..20: upstream amplification primer 99-21939 for SEQ 3814,
attagccaggaaggggagag

SEQ ID NO: 7749 - DNA, 20 bp, Homo Sapiens
  primer_bind 1..20: upstream amplification primer 99-22404 for SEQ 3815,
agtcagtgccagctacagtg

SEQ ID NO: 7750 - DNA, 18 bp, Homo Sapiens
  primer_bind 1..18: upstream amplification primer 99-22594 for SEQ 3816,
tactgagtgtttctcctg

SEQ ID NO: 7751 - DNA, 19 bp, Homo Sapiens
  primer_bind 1..19: upstream amplification primer 99-22679 for SEQ 3817,
caactttcaaatcccctcc

SEQ ID NO: 7752 - DNA, 20 bp, Homo Sapiens
  primer_bind 1..20: upstream amplification primer 99-23095 for SEQ 3818,
aatattcacagaggtccgag

SEQ ID NO: 7753 - DNA, 20 bp, Homo Sapiens
  primer_bind 1..20: upstream amplification primer 99-23370 for SEQ 3819,
ggaagtaaagagtaaacctg

SEQ ID NO: 7754 - DNA, 18 bp, Homo Sapiens
  primer_bind 1..18: upstream amplification primer 99-23568 for SEQ 3820,
cactacttggctcagttg

SEQ ID NO: 7755 - DNA, 19 bp, Homo Sapiens
  primer_bind 1..19: upstream amplification primer 99-23824 for SEQ 3821,
agccgttaatggttcaaag

SEQ ID NO: 7756 - DNA, 20 bp, Homo Sapiens
  primer_bind 1..20: upstream amplification primer 99-23969 for SEQ 3822,
gtaagataacacaacagaag

SEQ ID NO: 7757 - DNA, 19 bp, Homo Sapiens
  primer_bind 1..19: upstream amplification primer 99-24032 for SEQ 3823,
tcggtctgatgtacctcac

SEQ ID NO: 7758 - DNA, 20 bp, Homo Sapiens
  primer_bind 1..20: upstream amplification primer 99-24048 for SEQ 3824,
ctatcctgaccatccgtgtg

SEQ ID NO: 7759 - DNA, 21 bp, Homo Sapiens
  primer_bind 1..21: upstream amplification primer 99-24074 for SEQ 3825,
tgagcacccaagagagaactg

SEQ ID NO: 7760 - DNA, 21 bp, Homo Sapiens
  primer_bind 1..21: upstream amplification primer 99-24082 for SEQ 3826,
agtggcttggggtttgctttc

SEQ ID NO: 7761 - DNA, 20 bp, Homo Sapiens
  primer_bind 1..20: upstream amplification primer 99-24104 for SEQ 3827,
aacgtgccctcgctctttag

SEQ ID NO: 7762 - DNA, 19 bp, Homo Sapiens
  primer_bind 1..19: upstream amplification primer 99-24138 for SEQ 3828,
gtcacattgagggcattag

SEQ ID NO: 7763 - DNA, 20 bp, Homo Sapiens
  primer_bind 1..20: upstream amplification primer 99-24172 for SEQ 3829,
atgaggaaaattggacaaac

SEQ ID NO: 7764 - DNA, 19 bp, Homo Sapiens
  primer_bind 1..19: upstream amplification primer 99-24267 for SEQ 3830,
gtaaaaccagagtgcttag

SEQ ID NO: 7765 - DNA, 19 bp, Homo Sapiens
  primer_bind 1..19: upstream amplification primer 99-24949 for SEQ 3831,
aacctgcttggcaactcac

SEQ ID NO: 7766 - DNA, 20 bp, Homo Sapiens
  primer_bind 1..20: upstream amplification primer 99-253 for SEQ 3832,
aatgtaaacagatcgcacag

SEQ ID NO: 7767 - DNA, 20 bp, Homo Sapiens
  primer_bind 1..20: upstream amplification primer 99-2694 for SEQ 3833,
ttagcagccagtgtagtgcc

SEQ ID NO: 7768 - DNA, 18 bp, Homo Sapiens
  primer_bind 1..18: upstream amplification primer 99-2697 for SEQ 3834,
cttcaaatggaatggctg

SEQ ID NO: 7769 - DNA, 18 bp, Homo Sapiens
  primer_bind 1..18: upstream amplification primer 99-2720 for SEQ 3835,
gagtgggggatatagttg

SEQ ID NO: 7770 - DNA, 19 bp, Homo Sapiens
  primer_bind 1..19: upstream amplification primer 99-2851 for SEQ 3836,
agattctacacggtgctgg

SEQ ID NO: 7771 - DNA, 19 bp, Homo Sapiens
  primer_bind 1..19: upstream amplification primer 99-2889 for SEQ 3837,
tatcagggtggctttaggg

SEQ ID NO: 7772 - DNA, 19 bp, Homo Sapiens
  primer_bind 1..19: upstream amplification primer 99-3072 for SEQ 3838,
ctattgcattcaccccttc

SEQ ID NO: 7773 - DNA, 21 bp, Homo Sapiens
  primer_bind 1..21: upstream amplification primer 99-3089 for SEQ 3839,
gaacctaaaacctaaaagttg

SEQ ID NO: 7774 - DNA, 20 bp, Homo Sapiens
  primer_bind 1..20: upstream amplification primer 99-3157 for SEQ 3840,
aaaaaacctcccagaagaag

SEQ ID NO: 7775 - DNA, 21 bp, Homo Sapiens
  primer_bind 1..21: upstream amplification primer 99-3210 for SEQ 3841,
cctgccacttcatcagaaacc

SEQ ID NO: 7776 - DNA, 18 bp, Homo Sapiens
  primer_bind 1..18: upstream amplification primer 99-3218 for SEQ 3842,
atgatttgggggagtttc

SEQ ID NO: 7777 - DNA, 20 bp, Homo Sapiens
  primer_bind 1..20: upstream amplification primer 99-3251 for SEQ 3843,
atcacggtgagcaaagctgg

SEQ ID NO: 7778 - DNA, 18 bp, Homo Sapiens
  primer_bind 1..18: upstream amplification primer 99-3298 for SEQ 3844,
tgagggtgcagtgagaag

SEQ ID NO: 7779 - DNA, 19 bp, Homo Sapiens
  primer_bind 1..19: upstream amplification primer 99-3300 for SEQ 3845,
tccttccatctactttatc

SEQ ID NO: 7780 - DNA, 20 bp, Homo Sapiens
  primer_bind 1..20: upstream amplification primer 99-3364 for SEQ 3846,
caactcatcagtaaagaacc

SEQ ID NO: 7781 - DNA, 19 bp, Homo Sapiens
  primer_bind 1..19: upstream amplification primer 99-3427 for SEQ 3847,
atctacgctggcttgaagg

SEQ ID NO: 7782 - DNA, 20 bp, Homo Sapiens
  primer_bind 1..20: upstream amplification primer 99-3484 for SEQ 3848,
caccctaagcaataatatcc

SEQ ID NO: 7783 - DNA, 20 bp, Homo Sapiens
  primer_bind 1..20: upstream amplification primer 99-3537 for SEQ 3849,
ctgccatgtgcaaatgtgcc

SEQ ID NO: 7784 - DNA, 19 bp, Homo Sapiens
  primer_bind 1..19: upstream amplification primer 99-3568 for SEQ 3850,
agcattcagagggtgtagg

SEQ ID NO: 7785 - DNA, 20 bp, Homo Sapiens
  primer_bind 1..20: upstream amplification primer 99-3592 for SEQ 3851,
tgtatccacctgcctccttg

SEQ ID NO: 7786 - DNA, 18 bp, Homo Sapiens
  primer_bind 1..18: upstream amplification primer 99-3602 for SEQ 3852,
atcattccaccacacacc

SEQ ID NO: 7787 - DNA, 19 bp, Homo Sapiens
  primer_bind 1..19: upstream amplification primer 99-3608 for SEQ 3853,
gtgggtagaaagaataggg

SEQ ID NO: 7788 - DNA, 19 bp, Homo Sapiens
  primer_bind 1..19: upstream amplification primer 99-3643 for SEQ 3854,
ataaaaatgttagctgccc

SEQ ID NO: 7789 - DNA, 19 bp, Homo Sapiens
  primer_bind 1..19: upstream amplification primer 99-3770 for SEQ 3855,
ctctttctttcttatgggg

SEQ ID NO: 7790 - DNA, 19 bp, Homo Sapiens
  primer_bind 1..19: upstream amplification primer 99-3772 for SEQ 3856,
tagatgagttgaagaacag

SEQ ID NO: 7791 - DNA, 18 bp, Homo Sapiens
  primer_bind 1..18: upstream amplification primer 99-3790 for SEQ 3857,
gggtgtggaattgatgag

SEQ ID NO: 7792 - DNA, 18 bp, Homo Sapiens
  primer_bind 1..18: upstream amplification primer 99-3818 for SEQ 3858,
ggcttcaggtgctaaatc

SEQ ID NO: 7793 - DNA, 18 bp, Homo Sapiens
  primer_bind 1..18: upstream amplification primer 99-3863 for SEQ 3859,
caaggacagggaaagaag

SEQ ID NO: 7794 - DNA, 19 bp, Homo Sapiens
  primer_bind 1..19: upstream amplification primer 99-3879 for SEQ 3860,
gaaacagactgcaaatcac

SEQ ID NO: 7795 - DNA, 18 bp, Homo Sapiens
  primer_bind 1..18: upstream amplification primer 99-3882 for SEQ 3861,
ctctctgcctgttctttg

SEQ ID NO: 7796 - DNA, 20 bp, Homo Sapiens
  primer_bind 1..20: upstream amplification primer 99-3883 for SEQ 3862,
ggagaaacaaatggtaaaag

SEQ ID NO: 7797 - DNA, 18 bp, Homo Sapiens
  primer_bind 1..18: upstream amplification primer 99-3884 for SEQ 3863,
gactccataaattgcacc

SEQ ID NO: 7798 - DNA, 19 bp, Homo Sapiens
  primer_bind 1..19: upstream amplification primer 99-3894 for SEQ 3864,
cactcatcatccttgtctc

SEQ ID NO: 7799 - DNA, 20 bp, Homo Sapiens
  primer_bind 1..20: upstream amplification primer 99-3936 for SEQ 3865,
tgagcagtcagagtcttccc

SEQ ID NO: 7800 - DNA, 19 bp, Homo Sapiens
  primer_bind 1..19: upstream amplification primer 99-3946 for SEQ 3866,
caattaacagcagaccgag

SEQ ID NO: 7801 - DNA, 18 bp, Homo Sapiens
  primer_bind 1..18: upstream amplification primer 99-4029 for SEQ 3867,
ataggtgagtgagtgagg

SEQ ID NO: 7802 - DNA, 18 bp, Homo Sapiens
  primer_bind 1..18: upstream amplification primer 99-4036 for SEQ 3868,
atctgatgacacttctgg

SEQ ID NO: 7803 - DNA, 18 bp, Homo Sapiens
  primer_bind 1..18: upstream amplification primer 99-4102 for SEQ 3869,
ttccatccagcaaatgag

SEQ ID NO: 7804 - DNA, 18 bp, Homo Sapiens
  primer_bind 1..18: upstream amplification primer 99-4110 for SEQ 3870,
tgagcagaatcagggaag

SEQ ID NO: 7805 - DNA, 20 bp, Homo Sapiens
  primer_bind 1..20: upstream amplification primer 99-4111 for SEQ 3871,
ctgtctgctgtctatgatac

SEQ ID NO: 7806 - DNA, 21 bp, Homo Sapiens
  primer_bind 1..21: upstream amplification primer 99-4126 for SEQ 3872,
atcttgagtgttgggtggttg

SEQ ID NO: 7807 - DNA, 18 bp, Homo Sapiens
  primer_bind 1..18: upstream amplification primer 99-4157 for SEQ 3873,
aatgttgacagagacagg

SEQ ID NO: 7808 - DNA, 18 bp, Homo Sapiens
  primer_bind 1..18: upstream amplification primer 99-4228 for SEQ 3874,
aagactttctggacacac

SEQ ID NO: 7809 - DNA, 18 bp, Homo Sapiens
  primer_bind 1..18: upstream amplification primer 99-4239 for SEQ 3875,
ctactcattcacccatac

SEQ ID NO: 7810 - DNA, 20 bp, Homo Sapiens
  primer_bind 1..20: upstream amplification primer 99-4254 for SEQ 3876,
agaaacacctggggaggaac

SEQ ID NO: 7811 - DNA, 18 bp, Homo Sapiens
  primer_bind 1..18: upstream amplification primer 99-4264 for SEQ 3877,
caaataaaccctccgctc

SEQ ID NO: 7812 - DNA, 18 bp, Homo Sapiens
  primer_bind 1..18: upstream amplification primer 99-4311 for SEQ 3878,
ttagaagggggtagtagg

SEQ ID NO: 7813 - DNA, 18 bp, Homo Sapiens
  primer_bind 1..18: upstream amplification primer 99-4381 for SEQ 3879,
accccaaacccagaaaac

SEQ ID NO: 7814 - DNA, 21 bp, Homo Sapiens
  primer_bind 1..21: upstream amplification primer 99-4403 for SEQ 3880,
cgttgtgaagaaaaatgcgtc

SEQ ID NO: 7815 - DNA, 19 bp, Homo Sapiens
  primer_bind 1..19: upstream amplification primer 99-4524 for SEQ 3881,
tcttctctgtaggcactgg

SEQ ID NO: 7816 - DNA, 19 bp, Homo Sapiens
  primer_bind 1..19: upstream amplification primer 99-4582 for SEQ 3882,
gggggaagggaatgtgaag

SEQ ID NO: 7817 - DNA, 18 bp, Homo Sapiens
  primer_bind 1..18: upstream amplification primer 99-4611 for SEQ 3883,
aaaatacctctcagcgtg

SEQ ID NO: 7818 - DNA, 19 bp, Homo Sapiens
  primer_bind 1..19: upstream amplification primer 99-4689 for SEQ 3884,
ataggttatcagtgttgtg

SEQ ID NO: 7819 - DNA, 20 bp, Homo Sapiens
  primer_bind 1..20: upstream amplification primer 99-4762 for SEQ 3885,
atcctcctctttgcctcctc

SEQ ID NO: 7820 - DNA, 19 bp, Homo Sapiens
  primer_bind 1..19: upstream amplification primer 99-4878 for SEQ 3886,
agcttatgactgagtttcc

SEQ ID NO: 7821 - DNA, 18 bp, Homo Sapiens
  primer_bind 1..18: upstream amplification primer 99-5075 for SEQ 3887,
ggattgattatgggaagg

SEQ ID NO: 7822 - DNA, 18 bp, Homo Sapiens
  primer_bind 1..18: upstream amplification primer 99-5190 for SEQ 3888,
tgtttgtgactccagtcc

SEQ ID NO: 7823 - DNA, 18 bp, Homo Sapiens
  primer_bind 1..18: upstream amplification primer 99-5605 for SEQ 3889,
aagactccagtggctttg

SEQ ID NO: 7824 - DNA, 20 bp, Homo Sapiens
  primer_bind 1..20: upstream amplification primer 99-5882 for SEQ 3890,
ctgataatttactggtcttg

SEQ ID NO: 7825 - DNA, 18 bp, Homo Sapiens
  primer_bind 1..18: upstream amplification primer 99-5977 for SEQ 3891,
ccatgtattccagcctcg

SEQ ID NO: 7826 - DNA, 19 bp, Homo Sapiens
  primer_bind 1..19: upstream amplification primer 99-5993 for SEQ 3892,
tactctttagaaagtgtcc

SEQ ID NO: 7827 - DNA, 19 bp, Homo Sapiens
  primer_bind 1..19: upstream amplification primer 99-5994 for SEQ 3893,
cctttcaacacatctcttc

SEQ ID NO: 7828 - DNA, 18 bp, Homo Sapiens
  primer_bind 1..18: upstream amplification primer 99-6827 for SEQ 3894,
ttaatcaccttgcttccc

SEQ ID NO: 7829 - DNA, 18 bp, Homo Sapiens
  primer_bind 1..18: upstream amplification primer 99-7076 for SEQ 3895,
ctatccgatttcagagac

SEQ ID NO: 7830 - DNA, 19 bp, Homo Sapiens
  primer_bind 1..19: upstream amplification primer 99-7215 for SEQ 3896,
acctggatgcttctgcaac

SEQ ID NO: 7831 - DNA, 20 bp, Homo Sapiens
  primer_bind 1..20: upstream amplification primer 99-8206 for SEQ 3897,
ctgttatagtcttgccaatg

SEQ ID NO: 7832 - DNA, 20 bp, Homo Sapiens
  primer_bind 1..20: upstream amplification primer 99-8614 for SEQ 3898,
acacaagccctggttctctg

SEQ ID NO: 7833 - DNA, 18 bp, Homo Sapiens
  primer_bind 1..18: upstream amplification primer 99-889 for SEQ 3899,
tgatatgaggtgtgagac

SEQ ID NO: 7834 - DNA, 21 bp, Homo Sapiens
  primer_bind 1..21: upstream amplification primer 99-9450 for SEQ 3900,
gttaaatgagtgaagaaatcc

SEQ ID NO: 7835 - DNA, 21 bp, Homo Sapiens
  primer_bind 1..21: upstream amplification primer 99-9609 for SEQ 3901,
gattgccttccatctatatac

SEQ ID NO: 7836 - DNA, 19 bp, Homo Sapiens
  primer_bind 1..19: upstream amplification primer 99-9612 for SEQ 3902,
aagttcccacaattatacc

SEQ ID NO: 7837 - DNA, 20 bp, Homo Sapiens
  primer_bind 1..20: upstream amplification primer 99-9616 for SEQ 3903,
tagagggggtgtcaagtgag

SEQ ID NO: 7838 - DNA, 18 bp, Homo Sapiens
  primer_bind 1..18: upstream amplification primer 99-9683 for SEQ 3904,
gtcgcttctgttaaagtc

SEQ ID NO: 7839 - DNA, 19 bp, Homo Sapiens
  primer_bind 1..19: upstream amplification primer 99-9907 for SEQ 3905,
aataatctttggtttgggg

SEQ ID NO: 7840 - DNA, 19 bp, Homo Sapiens
  primer_bind 1..19: upstream amplification primer 99-993 for SEQ 3906,
agttccaggcacagagatg

SEQ ID NO: 7841 - DNA, 21 bp, Homo Sapiens
  primer_bind 1..21: upstream amplification primer 99-24069 for SEQ 3907,
catcaaggagaaggacctgac

SEQ ID NO: 7842 - DNA, 20 bp, Homo Sapiens
  primer_bind 1..20: upstream amplification primer 99-3855 for SEQ 3908,
gcacaatccttacaacactg

SEQ ID NO: 7843 - DNA, 20 bp, Homo Sapiens
  primer_bind 1..20: upstream amplification primer 99-344 for SEQ 3909,
gctctcatattcattgggtg

SEQ ID NO: 7844 - DNA, 18 bp, Homo Sapiens
  primer_bind 1..18: upstream amplification primer 99-366 for SEQ 3910,
tctctcccgtgttaaatg

SEQ ID NO: 7845 - DNA, 18 bp, Homo Sapiens
  primer_bind 1..18: upstream amplification primer 99-359 for SEQ 3911,
aatcttcttgctcctgtc

SEQ ID NO: 7846 - DNA, 18 bp, Homo Sapiens
  primer_bind 1..18: upstream amplification primer 99-355 for SEQ 3912,
aggttaggggtgtatttc

SEQ ID NO: 7847 - DNA, 18 bp, Homo Sapiens
  primer_bind 1..18: upstream amplification primer 99-365 for SEQ 3913,
agactgtgaccttagacc

SEQ ID NO: 7848 - DNA, 18 bp, Homo Sapiens
  primer_bind 1..18: upstream amplification primer 99-2452 for SEQ 3914,
gacgagaccatgaaggag

SEQ ID NO: 7849 - DNA, 18 bp, Homo Sapiens
  primer_bind 1..18: upstream amplification primer 99-123 for SEQ 3915,
aaagccaggactagaagg

SEQ ID NO: 7850 - DNA, 18 bp, Homo Sapiens
  primer_bind 1..18: upstream amplification primer 4-26 for SEQ 3916,
tacagccctgtaagacac

SEQ ID NO: 7851 - DNA, 18 bp, Homo Sapiens
  primer_bind 1..18: upstream amplification primer 4-14 for SEQ 3917,
tctaacctctcatccaac

SEQ ID NO: 7852 - DNA, 18 bp, Homo Sapiens
  primer_bind 1..18: upstream amplification primer 4-77 for SEQ 3918,
tgttgatttacaggcggc

SEQ ID NO: 7853 - DNA, 19 bp, Homo Sapiens
  primer_bind 1..19: upstream amplification primer 99-217 for SEQ 3919,
ggtgggaatttactatatg

SEQ ID NO: 7854 - DNA, 18 bp, Homo Sapiens
  primer_bind 1..18: upstream amplification primer 4-67 for SEQ 3920,
aagttcaccttctcaagc

SEQ ID NO: 7855 - DNA, 20 bp, Homo Sapiens
  primer_bind 1..20: upstream amplification primer 99-213 for SEQ 3921,
atactggcagcgtgtgcttc

SEQ ID NO: 7856 - DNA, 19 bp, Homo Sapiens
  primer_bind 1..19: upstream amplification primer 99-221 for SEQ 3922,
ccctttttcttcactgttc

SEQ ID NO: 7857 - DNA, 18 bp, Homo Sapiens
  primer_bind 1..18: upstream amplification primer 99-135 for SEQ 3923,
tggaagttgttattgccc

SEQ ID NO: 7858 - DNA, 21 bp, Homo Sapiens
  primer_bind 1..21: upstream amplification primer 99-1482 for SEQ 3924,
atcaaatcagtgaagtctgag

SEQ ID NO: 7859 - DNA, 18 bp, Homo Sapiens
  primer_bind 1..18: upstream amplification primer 4-73 for SEQ 3925,
atcgctggaacattctgg

SEQ ID NO: 7860 - DNA, 20 bp, Homo Sapiens
  primer_bind 1..20: upstream amplification primer 4-65 for SEQ 3926,
gatttaagctacgctattag

SEQ ID NO: 7861 - DNA, 19 bp, Homo Sapiens
  primer_bind 1..19: upstream amplification primer 10-32 for SEQ 3927,
aatgtaggagagtgtgctg

SEQ ID NO: 7862 - DNA, 19 bp, Homo Sapiens
  primer_bind 1..19: upstream amplification primer 10-33 for SEQ 3928, SEQ 3929, SEQ 3930,
ggacatttagggttgcttg

SEQ ID NO: 7863 - DNA, 18 bp, Homo Sapiens
  primer_bind 1..18: upstream amplification primer 10-35 for SEQ 3931, SEQ 3932,
gaaggttctcaggtttcc

SEQ ID NO: 7864 - DNA, 20 bp, Homo Sapiens
  primer_bind 1..20: upstream amplification primer 10-36 for SEQ 3933,
ggagctataatttaaacccc

SEQ ID NO: 7865 - DNA, 18 bp, Homo Sapiens
  primer_bind 1..18: upstream amplification primer 10-204 for SEQ 3934,
acagtatttggggcacag

SEQ ID NO: 7866 - DNA, 18 bp, Homo Sapiens
  primer_bind 1..18: downstream amplification primer 99-109 for SEQ 1, in complement
tccctcgtcttgaactac

SEQ ID NO: 7867 - DNA, 21 bp, Homo Sapiens
  primer_bind 1..21: downstream amplification primer 99-1126 for SEQ 2, in complement
atcttgactcatagatgatcc

SEQ ID NO: 7868 - DNA, 25 bp, Homo Sapiens
  primer_bind 1..25: downstream amplification primer 99-114 for SEQ 3, in complement
attgctgttttataggaaaggttgg

SEQ ID NO: 7869 - DNA, 18 bp, Homo Sapiens
  primer_bind 1..18: downstream amplification primer 99-1151 for SEQ 4, in complement
tgaacaccaacccttacc

SEQ ID NO: 7870 - DNA, 18 bp, Homo Sapiens
  primer_bind 1..18: downstream amplification primer 99-1165 for SEQ 5, in complement
ccaccagatgtgttttac

SEQ ID NO: 7871 - DNA, 19 bp, Homo Sapiens
  primer_bind 1..19: downstream amplification primer 99-1167 for SEQ 6, in complement
tgggcagaaaatgattaag

SEQ ID NO: 7872 - DNA, 25 bp, Homo Sapiens
  primer_bind 1..25: downstream amplification primer 99-117 for SEQ 7, in complement
tgggtaatgtttattgttagtcatc

SEQ ID NO: 7873 - DNA, 21 bp, Homo Sapiens
  primer_bind 1..21: downstream amplification primer 99-118 for SEQ 8, in complement
atctatatggctactgtcagg

SEQ ID NO: 7874 - DNA, 19 bp, Homo Sapiens
  primer_bind 1..19: downstream amplification primer 99-1217 for SEQ 9, in complement
ttctatggctacacatttc

SEQ ID NO: 7875 - DNA, 20 bp, Homo Sapiens
  primer_bind 1..20: downstream amplification primer 99-1233 for SEQ 10, in complement
agaagagaaaagaaggaaag

SEQ ID NO: 7876 - DNA, 21 bp, Homo Sapiens
  primer_bind 1..21: downstream amplification primer 99-12478 for SEQ 11, in complement
gactacgcagaaatggaaaac

SEQ ID NO: 7877 - DNA, 20 bp, Homo Sapiens
  primer_bind 1..20: downstream amplification primer 99-12487 for SEQ 12, in complement
aggtcttcacgagcagttgg

SEQ ID NO: 7878 - DNA, 21 bp, Homo Sapiens
  primer_bind 1..21: downstream amplification primer 99-12497 for SEQ 13, in complement
aatcatcaagccgaatcccac

SEQ ID NO: 7879 - DNA, 21 bp, Homo Sapiens
  primer_bind 1..21: downstream amplification primer 99-12503 for SEQ 14, in complement
tctcataacaggcaacacttc

SEQ ID NO: 7880 - DNA, 21 bp, Homo Sapiens
  primer_bind 1..21: downstream amplification primer 99-12504 for SEQ 15, in complement
tccatgaaatgtgatacaccc

SEQ ID NO: 7881 - DNA, 20 bp, Homo Sapiens
  primer_bind 1..20: downstream amplification primer 99-12505 for SEQ 16, in complement
aagtgggttctggtgtgtgg

SEQ ID NO: 7882 - DNA, 18 bp, Homo Sapiens
  primer_bind 1..18: downstream amplification primer 99-12506 for SEQ 17, in complement
ggtaaacttgcttcggtg

SEQ ID NO: 7883 - DNA, 21 bp, Homo Sapiens
  primer_bind 1..21: downstream amplification primer 99-12509 for SEQ 18, in complement
cagtcagcactccctactttc

SEQ ID NO: 7884 - DNA, 21 bp, Homo Sapiens
  primer_bind 1..21: downstream amplification primer 99-12513 for SEQ 19, in complement
cttgagagaggtgtggctatg

SEQ ID NO: 7885 - DNA, 20 bp, Homo Sapiens
  primer_bind 1..20: downstream amplification primer 99-12514 for SEQ 20, in complement
agttttttctgctgtctctg

SEQ ID NO: 7886 - DNA, 21 bp, Homo Sapiens
  primer_bind 1..21: downstream amplification primer 99-12515 for SEQ 21, in complement
taactcccaatatacatacac

SEQ ID NO: 7887 - DNA, 20 bp, Homo Sapiens
  primer_bind 1..20: downstream amplification primer 99-12516 for SEQ 22, in complement
aaaaccccactcagaacccc

SEQ ID NO: 7888 - DNA, 21 bp, Homo Sapiens
  primer_bind 1..21: downstream amplification primer 99-12518 for SEQ 23, in complement
attgagttccgaagtccatcc

SEQ ID NO: 7889 - DNA, 21 bp, Homo Sapiens
  primer_bind 1..21: downstream amplification primer 99-12523 for SEQ 24, in complement
gagcctaaatgcaaaccacac

SEQ ID NO: 7890 - DNA, 20 bp, Homo Sapiens
  primer_bind 1..20: downstream amplification primer 99-12525 for SEQ 25, in complement
ataggggtgagggtaacagg

SEQ ID NO: 7891 - DNA, 18 bp, Homo Sapiens
  primer_bind 1..18: downstream amplification primer 99-12526 for SEQ 26, in complement
ccgctgagatgcctttac

SEQ ID NO: 7892 - DNA, 21 bp, Homo Sapiens
  primer_bind 1..21: downstream amplification primer 99-12527 for SEQ 27, in complement
tgaggctatgattcggatggg

SEQ ID NO: 7893 - DNA, 21 bp, Homo Sapiens
  primer_bind 1..21: downstream amplification primer 99-12531 for SEQ 28, in complement
cagatgttggagttactaagg

SEQ ID NO: 7894 - DNA, 20 bp, Homo Sapiens
  primer_bind 1..20: downstream amplification primer 99-12532 for SEQ 29, in complement
cctggttgttcttgctcatc

SEQ ID NO: 7895 - DNA, 19 bp, Homo Sapiens
  primer_bind 1..19: downstream amplification primer 99-12534 for SEQ 30, in complement
gcaaattccacgatcacac

SEQ ID NO: 7896 - DNA, 21 bp, Homo Sapiens
  primer_bind 1..21: downstream amplification primer 99-12535 for SEQ 31, in complement
tacagaagtcaagagtgatgg

SEQ ID NO: 7897 - DNA, 21 bp, Homo Sapiens
  primer_bind 1..21: downstream amplification primer 99-12537 for SEQ 32, in complement
ccttctaccactatcccacac

SEQ ID NO: 7898 - DNA, 21 bp, Homo Sapiens
  primer_bind 1..21: downstream amplification primer 99-12538 for SEQ 33, in complement
caatgagacacatgggttctg

SEQ ID NO: 7899 - DNA, 21 bp, Homo Sapiens
  primer_bind 1..21: downstream amplification primer 99-12539 for SEQ 34, in complement
tcacagtcgcagacactaaag

SEQ ID NO: 7900 - DNA, 21 bp, Homo Sapiens
  primer_bind 1..21: downstream amplification primer 99-12540 for SEQ 35, in complement
tggtgctattcagatttgggg

SEQ ID NO: 7901 - DNA, 21 bp, Homo Sapiens
  primer_bind 1..21: downstream amplification primer 99-12541 for SEQ 36, in complement
ttttggtagggagagatgaag

SEQ ID NO: 7902 - DNA, 18 bp, Homo Sapiens
  primer_bind 1..18: downstream amplification primer 99-12545 for SEQ 37, in complement
cgctgggcttacattttc

SEQ ID NO: 7903 - DNA, 21 bp, Homo Sapiens
  primer_bind 1..21: downstream amplification primer 99-12548 for SEQ 38, in complement
aatcaccaccccaagtcttcg

SEQ ID NO: 7904 - DNA, 21 bp, Homo Sapiens
  primer_bind 1..21: downstream amplification primer 99-12558 for SEQ 39, in complement
tctttgctaagatggggctgg

SEQ ID NO: 7905 - DNA, 21 bp, Homo Sapiens
  primer_bind 1..21: downstream amplification primer 99-12562 for SEQ 40, in complement
ttgttgagtgtctgaaagctg

SEQ ID NO: 7906 - DNA, 21 bp, Homo Sapiens
  primer_bind 1..21: downstream amplification primer 99-12564 for SEQ 41, in complement
caagcagaaccagaatggaag

SEQ ID NO: 7907 - DNA, 21 bp, Homo Sapiens
  primer_bind 1..21: downstream amplification primer 99-12565 for SEQ 42, in complement
gaagcatccatcaatccaaag

SEQ ID NO: 7908 - DNA, 20 bp, Homo Sapiens
  primer_bind 1..20: downstream amplification primer 99-12575 for SEQ 43, in complement
atcctggctatgggcttctg

SEQ ID NO: 7909 - DNA, 21 bp, Homo Sapiens
  primer_bind 1..21: downstream amplification primer 99-12576 for SEQ 44, in complement
gaatgacctcaggacaatggg

SEQ ID NO: 7910 - DNA, 21 bp, Homo Sapiens
  primer_bind 1..21: downstream amplification primer 99-12580 for SEQ 45, in complement
tttagacagtgacggtgatgg

SEQ ID NO: 7911 - DNA, 21 bp, Homo Sapiens
  primer_bind 1..21: downstream amplification primer 99-12585 for SEQ 46, in complement
aggaacttggctttcattgtc

SEQ ID NO: 7912 - DNA, 21 bp, Homo Sapiens
  primer_bind 1..21: downstream amplification primer 99-12593 for SEQ 47, in complement
ataaacctgacacctatgggg

SEQ ID NO: 7913 - DNA, 21 bp, Homo Sapiens
  primer_bind 1..21: downstream amplification primer 99-12600 for SEQ 48, in complement
agaagtcaacctcccaacatc

SEQ ID NO: 7914 - DNA, 19 bp, Homo Sapiens
  primer_bind 1..19: downstream amplification primer 99-12608 for SEQ 49, in complement
ttcggtcctatgtagccag

SEQ ID NO: 7915 - DNA, 20 bp, Homo Sapiens
  primer_bind 1..20: downstream amplification primer 99-12610 for SEQ 50, in complement
gattttttctctattgtgcc

SEQ ID NO: 7916 - DNA, 21 bp, Homo Sapiens
  primer_bind 1..21: downstream amplification primer 99-12611 for SEQ 51, in complement
tgatttgagaaatattgtccc

SEQ ID NO: 7917 - DNA, 21 bp, Homo Sapiens
  primer_bind 1..21: downstream amplification primer 99-12613 for SEQ 52, in complement
ataagagcacagagagcgaag

SEQ ID NO: 7918 - DNA, 21 bp, Homo Sapiens
  primer_bind 1..21: downstream amplification primer 99-12615 for SEQ 53, in complement
aacaaccaagaaactcataag

SEQ ID NO: 7919 - DNA, 20 bp, Homo Sapiens
  primer_bind 1..20: downstream amplification primer 99-12617 for SEQ 54, in complement
tgacacttacccattaacag

SEQ ID NO: 7920 - DNA, 21 bp, Homo Sapiens
  primer_bind 1..21: downstream amplification primer 99-12618 for SEQ 55, in complement
cccagttaaaagatagctgag

SEQ ID NO: 7921 - DNA, 21 bp, Homo Sapiens
  primer_bind 1..21: downstream amplification primer 99-12619 for SEQ 56, in complement
tggaggaaatactctttaggg

SEQ ID NO: 7922 - DNA, 20 bp, Homo Sapiens
  primer_bind 1..20: downstream amplification primer 99-12621 for SEQ 57, in complement
cgagtaacagaattacttgg

SEQ ID NO: 7923 - DNA, 19 bp, Homo Sapiens
  primer_bind 1..19: downstream amplification primer 99-12624 for SEQ 58, in complement
gagaggatgtttgagtttc

SEQ ID NO: 7924 - DNA, 21 bp, Homo Sapiens
  primer_bind 1..21: downstream amplification primer 99-1263 for SEQ 59, in complement
ttcatacctcatacaactgcc

SEQ ID NO: 7925 - DNA, 20 bp, Homo Sapiens
  primer_bind 1..20: downstream amplification primer 99-12632 for SEQ 60, in complement
agttgaaggtcaggtgtggg

SEQ ID NO: 7926 - DNA, 21 bp, Homo Sapiens
  primer_bind 1..21: downstream amplification primer 99-12637 for SEQ 61, in complement
atctgctctactatattgacc

SEQ ID NO: 7927 - DNA, 21 bp, Homo Sapiens
  primer_bind 1..21: downstream amplification primer 99-12639 for SEQ 62, in complement
ccctcccttctcatcagatac

SEQ ID NO: 7928 - DNA, 21 bp, Homo Sapiens
  primer_bind 1..21: downstream amplification primer 99-12640 for SEQ 63, in complement
cctgcctttctcaatgagcac

SEQ ID NO: 7929 - DNA, 21 bp, Homo Sapiens
  primer_bind 1..21: downstream amplification primer 99-12650 for SEQ 64, in complement
ctcaggtaaaactattctatc

SEQ ID NO: 7930 - DNA, 21 bp, Homo Sapiens
  primer_bind 1..21: downstream amplification primer 99-12651 for SEQ 65, in complement
gtttaataatacgggtctggg

SEQ ID NO: 7931 - DNA, 21 bp, Homo Sapiens
  primer_bind 1..21: downstream amplification primer 99-12652 for SEQ 66, in complement
tttaaaaatgtggcaggtctc

SEQ ID NO: 7932 - DNA, 20 bp, Homo Sapiens
  primer_bind 1..20: downstream amplification primer 99-12654 for SEQ 67, in complement
atctggctgctccttcacac

SEQ ID NO: 7933 - DNA, 20 bp, Homo Sapiens
  primer_bind 1..20: downstream amplification primer 99-12656 for SEQ 68, in complement
tccagtcatggcaagcagag

SEQ ID NO: 7934 - DNA, 21 bp, Homo Sapiens
  primer_bind 1..21: downstream amplification primer 99-12658 for SEQ 69, in complement
tttgtgagtgtgagaaggatg

SEQ ID NO: 7935 - DNA, 21 bp, Homo Sapiens
  primer_bind 1..21: downstream amplification primer 99-12661 for SEQ 70, in complement
gatggtaaaatatgtatggag

SEQ ID NO: 7936 - DNA, 19 bp, Homo Sapiens
  primer_bind 1..19: downstream amplification primer 99-12668 for SEQ 71, in complement
atttgagtctaaactaccc

SEQ ID NO: 7937 - DNA, 21 bp, Homo Sapiens
  primer_bind 1..21: downstream amplification primer 99-1268 for SEQ 72, in complement
caaatctgaaaggtgtggctg

SEQ ID NO: 7938 - DNA, 20 bp, Homo Sapiens
  primer_bind 1..20: downstream amplification primer 99-12733 for SEQ 73, in complement
accttctactctcgtgcctg

SEQ ID NO: 7939 - DNA, 20 bp, Homo Sapiens
  primer_bind 1..20: downstream amplification primer 99-12738 for SEQ 74, in complement
cttgaccctaaaagaaattg

SEQ ID NO: 7940 - DNA, 21 bp, Homo Sapiens
  primer_bind 1..21: downstream amplification primer 99-12740 for SEQ 75, in complement
agccgtgaaagttcagagacc

SEQ ID NO: 7941 - DNA, 20 bp, Homo Sapiens
  primer_bind 1..20: downstream amplification primer 99-12749 for SEQ 76, in complement
aagagggattttaagttggg

SEQ ID NO: 7942 - DNA, 18 bp, Homo Sapiens
  primer_bind 1..18: downstream amplification primer 99-12750 for SEQ 77, in complement
cagcatcttgtaggtgac

SEQ ID NO: 7943 - DNA, 21 bp, Homo Sapiens
  primer_bind 1..21: downstream amplification primer 99-12751 for SEQ 78, in complement
cacaagctcatataattagac

SEQ ID NO: 7944 - DNA, 21 bp, Homo Sapiens
  primer_bind 1..21: downstream amplification primer 99-12755 for SEQ 79, in complement
gaaattaaggtgcagatgggg

SEQ ID NO: 7945 - DNA, 21 bp, Homo Sapiens
  primer_bind 1..21: downstream amplification primer 99-12756 for SEQ 80, in complement
tttcctgtctaccatttcccc

SEQ ID NO: 7946 - DNA, 18 bp, Homo Sapiens
  primer_bind 1..18: downstream amplification primer 99-12757 for SEQ 81, in complement
agatgaccgatgtaagcc

SEQ ID NO: 7947 - DNA, 21 bp, Homo Sapiens
  primer_bind 1..21: downstream amplification primer 99-12759 for SEQ 82, in complement
cttgtttgaaagcctaaggtg

SEQ ID NO: 7948 - DNA, 20 bp, Homo Sapiens
  primer_bind 1..20: downstream amplification primer 99-12777 for SEQ 83, in complement
aaatagacgaatggcagaag

SEQ ID NO: 7949 - DNA, 21 bp, Homo Sapiens
  primer_bind 1..21: downstream amplification primer 99-12782 for SEQ 84, in complement
aagcagaactaaattcaatcg

SEQ ID NO: 7950 - DNA, 21 bp, Homo Sapiens
  primer_bind 1..21: downstream amplification primer 99-12794 for SEQ 85, in complement
gtttgtaaaatacttagagcc

SEQ ID NO: 7951 - DNA, 18 bp, Homo Sapiens
  primer_bind 1..18: downstream amplification primer 99-128 for SEQ 86, in complement
agagcgttcttgcctttc

SEQ ID NO: 7952 - DNA, 21 bp, Homo Sapiens
  primer_bind 1..21: downstream amplification primer 99-12816 for SEQ 87, in complement
cctttcttttgttcccctctg

SEQ ID NO: 7953 - DNA, 20 bp, Homo Sapiens
  primer_bind 1..20: downstream amplification primer 99-12817 for SEQ 88, in complement
tcgcacacagcaaagaggac

SEQ ID NO: 7954 - DNA, 20 bp, Homo Sapiens
  primer_bind 1..20: downstream amplification primer 99-12819 for SEQ 89, in complement
gtcaaatggaggagaagggg

SEQ ID NO: 7955 - DNA, 21 bp, Homo Sapiens
  primer_bind 1..21: downstream amplification primer 99-12826 for SEQ 90, in complement
tctgctgtatcttcgcatctc

SEQ ID NO: 7956 - DNA, 21 bp, Homo Sapiens
  primer_bind 1..21: downstream amplification primer 99-12831 for SEQ 91, in complement
acgggtgtgctctaaatgctc

SEQ ID NO: 7957 - DNA, 20 bp, Homo Sapiens
  primer_bind 1..20: downstream amplification primer 99-12836 for SEQ 92, in complement
ctccagtccctatttcctcc

SEQ ID NO: 7958 - DNA, 21 bp, Homo Sapiens
  primer_bind 1..21: downstream amplification primer 99-12842 for SEQ 93, in complement
ttctcacatacaccttctcac

SEQ ID NO: 7959 - DNA, 18 bp, Homo Sapiens
  primer_bind 1..18: downstream amplification primer 99-12843 for SEQ 94, in complement
ctaggtgaagctaatggg

SEQ ID NO: 7960 - DNA, 21 bp, Homo Sapiens
  primer_bind 1..21: downstream amplification primer 99-12844 for SEQ 95, in complement
ttttccccctgactttcgctg

SEQ ID NO: 7961 - DNA, 21 bp, Homo Sapiens
  primer_bind 1..21: downstream amplification primer 99-12847 for SEQ 96, in complement
gattaagttggtcttcctctg

SEQ ID NO: 7962 - DNA, 20 bp, Homo Sapiens
  primer_bind 1..20: downstream amplification primer 99-12848 for SEQ 97, in complement
tgccttccccaccatttacc

SEQ ID NO: 7963 - DNA, 21 bp, Homo Sapiens
  primer_bind 1..21: downstream amplification primer 99-12852 for SEQ 98, in complement
cttttaacaccctttgagcac

SEQ ID NO: 7964 - DNA, 21 bp, Homo Sapiens
  primer_bind 1..21: downstream amplification primer 99-12856 for SEQ 99, in complement
caaccaggctgacatcactac

SEQ ID NO: 7965 - DNA, 21 bp, Homo Sapiens
  primer_bind 1..21: downstream amplification primer 99-12878 for SEQ 100, in complement
aaccatcaaaagtccattttc

SEQ ID NO: 7966 - DNA, 21 bp, Homo Sapiens
  primer_bind 1..21: downstream amplification primer 99-12880 for SEQ 101, in complement
tacttttctgggtctcattgg

SEQ ID NO: 7967 - DNA, 20 bp, Homo Sapiens
  primer_bind 1..20: downstream amplification primer 99-12884 for SEQ 102, in complement
aaaactatccatctacccac

SEQ ID NO: 7968 - DNA, 21 bp, Homo Sapiens
  primer_bind 1..21: downstream amplification primer 99-12885 for SEQ 103, in complement
gaaagaagcagagttggttag

SEQ ID NO: 7969 - DNA, 20 bp, Homo Sapiens
  primer_bind 1..20: downstream amplification primer 99-12898 for SEQ 104, in complement
aagccctctgcttacaaccc

SEQ ID NO: 7970 - DNA, 21 bp, Homo Sapiens
  primer_bind 1..21: downstream amplification primer 99-12899 for SEQ 105, in complement
tctttagctgggggactactg

SEQ ID NO: 7971 - DNA, 19 bp, Homo Sapiens
  primer_bind 1..19: downstream amplification primer 99-1290 for SEQ 106, in complement
atttctccacaatctttcc

SEQ ID NO: 7972 - DNA, 19 bp, Homo Sapiens
  primer_bind 1..19: downstream amplification primer 99-12900 for SEQ 107, in complement
gccacacaaagccttcaac

SEQ ID NO: 7973 - DNA, 20 bp, Homo Sapiens
  primer_bind 1..20: downstream amplification primer 99-12901 for SEQ 108, in complement
gagagactgcccgcttttag

SEQ ID NO: 7974 - DNA, 21 bp, Homo Sapiens
  primer_bind 1..21: downstream amplification primer 99-12903 for SEQ 109, in complement
tctgagtatttttggtctgtg

SEQ ID NO: 7975 - DNA, 20 bp, Homo Sapiens
  primer_bind 1..20: downstream amplification primer 99-12907 for SEQ 110, in complement
ggtaaccctaaaatgttatc

SEQ ID NO: 7976 - DNA, 21 bp, Homo Sapiens
  primer_bind 1..21: downstream amplification primer 99-12908 for SEQ 111, in complement
agtttaaggcaagtccatctc

SEQ ID NO: 7977 - DNA, 21 bp, Homo Sapiens
  primer_bind 1..21: downstream amplification primer 99-12913 for SEQ 112, in complement
gacaattacacctatgctcac

SEQ ID NO: 7978 - DNA, 21 bp, Homo Sapiens
  primer_bind 1..21: downstream amplification primer 99-12914 for SEQ 113, in complement
caatgagaaagcatcgagaag

SEQ ID NO: 7979 - DNA, 18 bp, Homo Sapiens
  primer_bind 1..18: downstream amplification primer 99-12924 for SEQ 114, in complement
ttcgagccaccacttatg

SEQ ID NO: 7980 - DNA, 21 bp, Homo Sapiens
  primer_bind 1..21: downstream amplification primer 99-12925 for SEQ 115, in complement
attcttgagttaaagcacccc

SEQ ID NO: 7981 - DNA, 21 bp, Homo Sapiens
  primer_bind 1..21: downstream amplification primer 99-12926 for SEQ 116, in complement
caatacatgcctagtaaatac

SEQ ID NO: 7982 - DNA, 20 bp, Homo Sapiens
  primer_bind 1..20: downstream amplification primer 99-12931 for SEQ 117, in complement
tacaccaccaaaccccaacc

SEQ ID NO: 7983 - DNA, 20 bp, Homo Sapiens
  primer_bind 1..20: downstream amplification primer 99-12948 for SEQ 118, in complement
aagtagacacccaaataacc

SEQ ID NO: 7984 - DNA, 21 bp, Homo Sapiens
  primer_bind 1..21: downstream amplification primer 99-12952 for SEQ 119, in complement
aaagaaaactactgcctgccc

SEQ ID NO: 7985 - DNA, 21 bp, Homo Sapiens
  primer_bind 1..21: downstream amplification primer 99-12956 for SEQ 120, in complement
ctgggatgattaaggcaaaag

SEQ ID NO: 7986 - DNA, 20 bp, Homo Sapiens
  primer_bind 1..20: downstream amplification primer 99-12957 for SEQ 121, in complement
gtcgtatattgcccaacagc

SEQ ID NO: 7987 - DNA, 21 bp, Homo Sapiens
  primer_bind 1..21: downstream amplification primer 99-12961 for SEQ 122, in complement
tgacgtgatttgaagacacag

SEQ ID NO: 7988 - DNA, 21 bp, Homo Sapiens
  primer_bind 1..21: downstream amplification primer 99-12962 for SEQ 123, in complement
acaagtcagatgaagtccccc

SEQ ID NO: 7989 - DNA, 19 bp, Homo Sapiens
  primer_bind 1..19: downstream amplification primer 99-12963 for SEQ 124, in complement
tagtaggactgaaggaggg

SEQ ID NO: 7990 - DNA, 20 bp, Homo Sapiens
  primer_bind 1..20: downstream amplification primer 99-12964 for SEQ 125, in complement
gcaatgtgaattgtagagcc

SEQ ID NO: 7991 - DNA, 21 bp, Homo Sapiens
  primer_bind 1..21: downstream amplification primer 99-13021 for SEQ 126, in complement
tgttgttccttgataagcctg

SEQ ID NO: 7992 - DNA, 21 bp, Homo Sapiens
  primer_bind 1..21: downstream amplification primer 99-13036 for SEQ 127, in complement
accacataatctcgcaaagac

SEQ ID NO: 7993 - DNA, 19 bp, Homo Sapiens
  primer_bind 1..19: downstream amplification primer 99-13045 for SEQ 128, in complement
cagcataaaggaaaggaag

SEQ ID NO: 7994 - DNA, 21 bp, Homo Sapiens
  primer_bind 1..21: downstream amplification primer 99-13051 for SEQ 129, in complement
tggatagacccgatgtgtgag

SEQ ID NO: 7995 - DNA, 19 bp, Homo Sapiens
  primer_bind 1..19: downstream amplification primer 99-13061 for SEQ 130, in complement
cttcttttgagtgttagtg

SEQ ID NO: 7996 - DNA, 21 bp, Homo Sapiens
  primer_bind 1..21: downstream amplification primer 99-13064 for SEQ 131, in complement
caatgttgatgaaaaatgacc

SEQ ID NO: 7997 - DNA, 21 bp, Homo Sapiens
  primer_bind 1..21: downstream amplification primer 99-13065 for SEQ 132, in complement
ggtgcttctgatgaacttgac

SEQ ID NO: 7998 - DNA, 21 bp, Homo Sapiens
  primer_bind 1..21: downstream amplification primer 99-13070 for SEQ 133, in complement
taaacctgatgaagatggctg

SEQ ID NO: 7999 - DNA, 21 bp, Homo Sapiens
  primer_bind 1..21: downstream amplification primer 99-13098 for SEQ 134, in complement
ctgcttccagccacaacatac

SEQ ID NO: 8000 - DNA, 19 bp, Homo Sapiens
  primer_bind 1..19: downstream amplification primer 99-13106 for SEQ 135, in complement
aaatatgtgttgacagacc

SEQ ID NO: 8001 - DNA, 19 bp, Homo Sapiens
  primer_bind 1..19: downstream amplification primer 99-13115 for SEQ 136, in complement
ctcctaaattccttatctc

SEQ ID NO: 8002 - DNA, 21 bp, Homo Sapiens
  primer_bind 1..21: downstream amplification primer 99-13121 for SEQ 137, in complement
cagactgttggctgtaattgg

SEQ ID NO: 8003 - DNA, 19 bp, Homo Sapiens
  primer_bind 1..19: downstream amplification primer 99-13130 for SEQ 138, in complement
aattaggtatgtaaggagg

SEQ ID NO: 8004 - DNA, 18 bp, Homo Sapiens
  primer_bind 1..18: downstream amplification primer 99-13133 for SEQ 139, in complement
tttaagcaccgagtctac

SEQ ID NO: 8005 - DNA, 21 bp, Homo Sapiens
  primer_bind 1..21: downstream amplification primer 99-13134 for SEQ 140, in complement
aacagggtcttagcattgtgg

SEQ ID NO: 8006 - DNA, 21 bp, Homo Sapiens
  primer_bind 1..21: downstream amplification primer 99-13165 for SEQ 141, in complement
tcataccttaaccatacaaac

SEQ ID NO: 8007 - DNA, 20 bp, Homo Sapiens
  primer_bind 1..20: downstream amplification primer 99-13178 for SEQ 142, in complement
cttcatttcagtgccatatc

SEQ ID NO: 8008 - DNA, 20 bp, Homo Sapiens
  primer_bind 1..20: downstream amplification primer 99-13192 for SEQ 143, in complement
aacaatgaagccgaaacaac

SEQ ID NO: 8009 - DNA, 18 bp, Homo Sapiens
  primer_bind 1..18: downstream amplification primer 99-13193 for SEQ 144, in complement
atgcacgctcacaatcac

SEQ ID NO: 8010 - DNA, 21 bp, Homo Sapiens
  primer_bind 1..21: downstream amplification primer 99-13201 for SEQ 145, in complement
caatgttctactcttgttttc

SEQ ID NO: 8011 - DNA, 21 bp, Homo Sapiens
  primer_bind 1..21: downstream amplification primer 99-13203 for SEQ 146, in complement
ttttaataagcaccccgcatc

SEQ ID NO: 8012 - DNA, 21 bp, Homo Sapiens
  primer_bind 1..21: downstream amplification primer 99-13215 for SEQ 147, in complement
tattgagaggttaaagcatgg

SEQ ID NO: 8013 - DNA, 20 bp, Homo Sapiens
  primer_bind 1..20: downstream amplification primer 99-13218 for SEQ 148, in complement
aatttgaggcattgaagcag

SEQ ID NO: 8014 - DNA, 21 bp, Homo Sapiens
  primer_bind 1..21: downstream amplification primer 99-13219 for SEQ 149, in complement
tttccctatgaggtggctctg

SEQ ID NO: 8015 - DNA, 18 bp, Homo Sapiens
  primer_bind 1..18: downstream amplification primer 99-13222 for SEQ 150, in complement
gacagaatacaggggagg

SEQ ID NO: 8016 - DNA, 21 bp, Homo Sapiens
  primer_bind 1..21: downstream amplification primer 99-13224 for SEQ 151, in complement
cccttctgaccttactttctc

SEQ ID NO: 8017 - DNA, 21 bp, Homo Sapiens
  primer_bind 1..21: downstream amplification primer 99-13227 for SEQ 152, in complement
tggtgtctgatgtgtcactgg

SEQ ID NO: 8018 - DNA, 19 bp, Homo Sapiens
  primer_bind 1..19: downstream amplification primer 99-13229 for SEQ 153, in complement
cttatctaaggtgtggttc

SEQ ID NO: 8019 - DNA, 18 bp, Homo Sapiens
  primer_bind 1..18: downstream amplification primer 99-13232 for SEQ 154, in complement
tgcattcagaggagacac

SEQ ID NO: 8020 - DNA, 21 bp, Homo Sapiens
  primer_bind 1..21: downstream amplification primer 99-13237 for SEQ 155, in complement
cctctttagaattgtcttgcc

SEQ ID NO: 8021 - DNA, 18 bp, Homo Sapiens
  primer_bind 1..18: downstream amplification primer 99-13238 for SEQ 156, in complement
ccctcctgagagtggaag

SEQ ID NO: 8022 - DNA, 21 bp, Homo Sapiens
  primer_bind 1..21: downstream amplification primer 99-13241 for SEQ 157, in complement
gttcccccaaagaattactcc

SEQ ID NO: 8023 - DNA, 18 bp, Homo Sapiens
  primer_bind 1..18: downstream amplification primer 99-13246 for SEQ 158, in complement
catcccatatcccactac

SEQ ID NO: 8024 - DNA, 20 bp, Homo Sapiens
  primer_bind 1..20: downstream amplification primer 99-13250 for SEQ 159, in complement
aggtctacacgcctcttctc

SEQ ID NO: 8025 - DNA, 19 bp, Homo Sapiens
  primer_bind 1..19: downstream amplification primer 99-13251 for SEQ 160, in complement
cccatctctgtagagtttc

SEQ ID NO: 8026 - DNA, 21 bp, Homo Sapiens
  primer_bind 1..21: downstream amplification primer 99-13258 for SEQ 161, in complement
cgtctttgtagagttttaacc

SEQ ID NO: 8027 - DNA, 20 bp, Homo Sapiens
  primer_bind 1..20: downstream amplification primer 99-13260 for SEQ 162, in complement
ccagcatcacgttgttttcc

SEQ ID NO: 8028 - DNA, 21 bp, Homo Sapiens
  primer_bind 1..21: downstream amplification primer 99-13262 for SEQ 163, in complement
ttgtctctatcttgtaacttc

SEQ ID NO: 8029 - DNA, 21 bp, Homo Sapiens
  primer_bind 1..21: downstream amplification primer 99-13269 for SEQ 164, in complement
gatggcaaactgaaggttaag

SEQ ID NO: 8030 - DNA, 21 bp, Homo Sapiens
  primer_bind 1..21: downstream amplification primer 99-13270 for SEQ 165, in complement
ttctcaacttcaagtctcctc

SEQ ID NO: 8031 - DNA, 18 bp, Homo Sapiens
  primer_bind 1..18: downstream amplification primer 99-13271 for SEQ 166, in complement
catgcagtagagggaaag

SEQ ID NO: 8032 - DNA, 18 bp, Homo Sapiens
  primer_bind 1..18: downstream amplification primer 99-13272 for SEQ 167, in complement
acgttagggctttgatag

SEQ ID NO: 8033 - DNA, 19 bp, Homo Sapiens
  primer_bind 1..19: downstream amplification primer 99-13273 for SEQ 168, in complement
aaagaaaagggagagtttg

SEQ ID NO: 8034 - DNA, 20 bp, Homo Sapiens
  primer_bind 1..20: downstream amplification primer 99-13276 for SEQ 169, in complement
gtgtctcagcaaaataaatc

SEQ ID NO: 8035 - DNA, 21 bp, Homo Sapiens
  primer_bind 1..21: downstream amplification primer 99-13279 for SEQ 170, in complement
ttccataatttgattcgggtc

SEQ ID NO: 8036 - DNA, 19 bp, Homo Sapiens
  primer_bind 1..19: downstream amplification primer 99-13286 for SEQ 171, in complement
acagccatagaataatgtc

SEQ ID NO: 8037 - DNA, 18 bp, Homo Sapiens
  primer_bind 1..18: downstream amplification primer 99-13287 for SEQ 172, in complement
tgatgggcattagccttc

SEQ ID NO: 8038 - DNA, 20 bp, Homo Sapiens
  primer_bind 1..20: downstream amplification primer 99-13294 for SEQ 173, in complement
tctgtgccatgacccctttg

SEQ ID NO: 8039 - DNA, 19 bp, Homo Sapiens
  primer_bind 1..19: downstream amplification primer 99-13296 for SEQ 174, in complement
atatcttgttcttacaggg

SEQ ID NO: 8040 - DNA, 20 bp, Homo Sapiens
  primer_bind 1..20: downstream amplification primer 99-13320 for SEQ 175, in complement
tccctgtgctcctgtaatgc

SEQ ID NO: 8041 - DNA, 21 bp, Homo Sapiens
  primer_bind 1..21: downstream amplification primer 99-13332 for SEQ 176, in complement
ggtgttatttagagggtttgg

SEQ ID NO: 8042 - DNA, 21 bp, Homo Sapiens
  primer_bind 1..21: downstream amplification primer 99-13334 for SEQ 177, in complement
caaaccgagaacccccaaaac

SEQ ID NO: 8043 - DNA, 21 bp, Homo Sapiens
  primer_bind 1..21: downstream amplification primer 99-13336 for SEQ 178, in complement
attctccgtttctccattgcc

SEQ ID NO: 8044 - DNA, 21 bp, Homo Sapiens
  primer_bind 1..21: downstream amplification primer 99-13339 for SEQ 179, in complement
ctgttctgattctgatttgtg

SEQ ID NO: 8045 - DNA, 18 bp, Homo Sapiens
  primer_bind 1..18: downstream amplification primer 99-13354 for SEQ 180, in complement
tctgttctctctctgtcc

SEQ ID NO: 8046 - DNA, 21 bp, Homo Sapiens
  primer_bind 1..21: downstream amplification primer 99-13368 for SEQ 181, in complement
tgctgaatgccaagttttgcc

SEQ ID NO: 8047 - DNA, 18 bp, Homo Sapiens
  primer_bind 1..18: downstream amplification primer 99-13394 for SEQ 182, in complement
ggtcatttagggaagtag

SEQ ID NO: 8048 - DNA, 21 bp, Homo Sapiens
  primer_bind 1..21: downstream amplification primer 99-13395 for SEQ 183, in complement
accatagtatcccctacaatc

SEQ ID NO: 8049 - DNA, 18 bp, Homo Sapiens
  primer_bind 1..18: downstream amplification primer 99-13396 for SEQ 184, in complement
taaagccacacctgtttc

SEQ ID NO: 8050 - DNA, 19 bp, Homo Sapiens
  primer_bind 1..19: downstream amplification primer 99-134 for SEQ 185, in complement
acagtgcaaaggttatatc

SEQ ID NO: 8051 - DNA, 21 bp, Homo Sapiens
  primer_bind 1..21: downstream amplification primer 99-13401 for SEQ 186, in complement
gatgggagaataggaaagatg

SEQ ID NO: 8052 - DNA, 21 bp, Homo Sapiens
  primer_bind 1..21: downstream amplification primer 99-13404 for SEQ 187, in complement
aatttggacgttaaaaagagg

SEQ ID NO: 8053 - DNA, 18 bp, Homo Sapiens
  primer_bind 1..18: downstream amplification primer 99-13406 for SEQ 188, in complement
ggatgtgttagagaggtg

SEQ ID NO: 8054 - DNA, 19 bp, Homo Sapiens
  primer_bind 1..19: downstream amplification primer 99-1342 for SEQ 189, in complement
agttcattctttgtcactc

SEQ ID NO: 8055 - DNA, 19 bp, Homo Sapiens
  primer_bind 1..19: downstream amplification primer 99-13429 for SEQ 190, in complement
gtgattatgatgaaccctg

SEQ ID NO: 8056 - DNA, 20 bp, Homo Sapiens
  primer_bind 1..20: downstream amplification primer 99-13439 for SEQ 191, in complement
tcggactgagtggtgagatg

SEQ ID NO: 8057 - DNA, 21 bp, Homo Sapiens
  primer_bind 1..21: downstream amplification primer 99-13443 for SEQ 192, in complement
cttctcatctctcccagtctc

SEQ ID NO: 8058 - DNA, 19 bp, Homo Sapiens
  primer_bind 1..19: downstream amplification primer 99-13450 for SEQ 193, in complement
aaatcatagttctgtgctg

SEQ ID NO: 8059 - DNA, 19 bp, Homo Sapiens
  primer_bind 1..19: downstream amplification primer 99-13457 for SEQ 194, in complement
tttggctcttctctgcctg

SEQ ID NO: 8060 - DNA, 19 bp, Homo Sapiens
  primer_bind 1..19: downstream amplification primer 99-1346 for SEQ 195, in complement
atgggaagacagagaccac

SEQ ID NO: 8061 - DNA, 20 bp, Homo Sapiens
  primer_bind 1..20: downstream amplification primer 99-13462 for SEQ 196, in complement
gttcattttagacacagatg

SEQ ID NO: 8062 - DNA, 20 bp, Homo Sapiens
  primer_bind 1..20: downstream amplification primer 99-13486 for SEQ 197, in complement
agagccaagcctacaggaac

SEQ ID NO: 8063 - DNA, 21 bp, Homo Sapiens
  primer_bind 1..21: downstream amplification primer 99-13489 for SEQ 198, in complement
gtgctcacaagaaccaacaac

SEQ ID NO: 8064 - DNA, 19 bp, Homo Sapiens
  primer_bind 1..19: downstream amplification primer 99-13499 for SEQ 199, in complement
ctcatcataattttacccc

SEQ ID NO: 8065 - DNA, 21 bp, Homo Sapiens
  primer_bind 1..21: downstream amplification primer 99-13502 for SEQ 200, in complement
gaggcaaaaaagtgaagtgag

SEQ ID NO: 8066 - DNA, 21 bp, Homo Sapiens
  primer_bind 1..21: downstream amplification primer 99-13509 for SEQ 201, in complement
gctcacaatgaaagcaatgac

SEQ ID NO: 8067 - DNA, 21 bp, Homo Sapiens
  primer_bind 1..21: downstream amplification primer 99-1351 for SEQ 202, in complement
agtagttgtctctgtggaagg

SEQ ID NO: 8068 - DNA, 19 bp, Homo Sapiens
  primer_bind 1..19: downstream amplification primer 99-13515 for SEQ 203, in complement
cctattagtcagtgtggag

SEQ ID NO: 8069 - DNA, 18 bp, Homo Sapiens
  primer_bind 1..18: downstream amplification primer 99-13525 for SEQ 204, in complement
gcacacctcatcttgacc

SEQ ID NO: 8070 - DNA, 21 bp, Homo Sapiens
  primer_bind 1..21: downstream amplification primer 99-13526 for SEQ 205, in complement
aatccccatcatccttatccc

SEQ ID NO: 8071 - DNA, 21 bp, Homo Sapiens
  primer_bind 1..21: downstream amplification primer 99-13531 for SEQ 206, in complement
agtacgtgtttaccaaaagtc

SEQ ID NO: 8072 - DNA, 21 bp, Homo Sapiens
  primer_bind 1..21: downstream amplification primer 99-13536 for SEQ 207, in complement
aaaaacattgtatgcaactcc

SEQ ID NO: 8073 - DNA, 21 bp, Homo Sapiens
  primer_bind 1..21: downstream amplification primer 99-13540 for SEQ 208, in complement
cccccacctcataatgttatc

SEQ ID NO: 8074 - DNA, 21 bp, Homo Sapiens
  primer_bind 1..21: downstream amplification primer 99-13541 for SEQ 209, in complement
aaaccaatttctgctcctgac

SEQ ID NO: 8075 - DNA, 20 bp, Homo Sapiens
  primer_bind 1..20: downstream amplification primer 99-13545 for SEQ 210, in complement
cttctaaccatctacacttc

SEQ ID NO: 8076 - DNA, 19 bp, Homo Sapiens
  primer_bind 1..19: downstream amplification primer 99-13552 for SEQ 211, in complement
cagaataagctgtgttgtc

SEQ ID NO: 8077 - DNA, 21 bp, Homo Sapiens
  primer_bind 1..21: downstream amplification primer 99-13553 for SEQ 212, in complement
gaattttccaaaagactgaag

SEQ ID NO: 8078 - DNA, 21 bp, Homo Sapiens
  primer_bind 1..21: downstream amplification primer 99-13555 for SEQ 213, in complement
aagtaggttgaagttgaagtg

SEQ ID NO: 8079 - DNA, 21 bp, Homo Sapiens
  primer_bind 1..21: downstream amplification primer 99-1356 for SEQ 214, in complement
tgtttgttcattagtttgtcc

SEQ ID NO: 8080 - DNA, 21 bp, Homo Sapiens
  primer_bind 1..21: downstream amplification primer 99-13567 for SEQ 215, in complement
aattctttcttcctataaggc

SEQ ID NO: 8081 - DNA, 21 bp, Homo Sapiens
  primer_bind 1..21: downstream amplification primer 99-13586 for SEQ 216, in complement
gtgtgtgggcatttaaaccag

SEQ ID NO: 8082 - DNA, 19 bp, Homo Sapiens
  primer_bind 1..19: downstream amplification primer 99-13588 for SEQ 217, in complement
aatgctggcgttctccatc

SEQ ID NO: 8083 - DNA, 21 bp, Homo Sapiens
  primer_bind 1..21: downstream amplification primer 99-13589 for SEQ 218, in complement
tttccctcccactgtgttctc

SEQ ID NO: 8084 - DNA, 18 bp, Homo Sapiens
  primer_bind 1..18: downstream amplification primer 99-1359 for SEQ 219, in complement
tctaagcaccagggaaac

SEQ ID NO: 8085 - DNA, 19 bp, Homo Sapiens
  primer_bind 1..19: downstream amplification primer 99-13591 for SEQ 220, in complement
atggagttgtaaggaaatc

SEQ ID NO: 8086 - DNA, 20 bp, Homo Sapiens
  primer_bind 1..20: downstream amplification primer 99-13592 for SEQ 221, in complement
ccatcactcaaaccaaaatc

SEQ ID NO: 8087 - DNA, 21 bp, Homo Sapiens
  primer_bind 1..21: downstream amplification primer 99-13596 for SEQ 222, in complement
aagcaaagagcagaagtccac

SEQ ID NO: 8088 - DNA, 21 bp, Homo Sapiens
  primer_bind 1..21: downstream amplification primer 99-13598 for SEQ 223, in complement
catccaacccacagaatatcc

SEQ ID NO: 8089 - DNA, 18 bp, Homo Sapiens
  primer_bind 1..18: downstream amplification primer 99-13600 for SEQ 224, in complement
gacttaacagtgccatcc

SEQ ID NO: 8090 - DNA, 19 bp, Homo Sapiens
  primer_bind 1..19: downstream amplification primer 99-13601 for SEQ 225, in complement
aatatctttgtagacctcc

SEQ ID NO: 8091 - DNA, 18 bp, Homo Sapiens
  primer_bind 1..18: downstream amplification primer 99-13605 for SEQ 226, in complement
tgtcaccaaaactgactc

SEQ ID NO: 8092 - DNA, 18 bp, Homo Sapiens
  primer_bind 1..18: downstream amplification primer 99-13606 for SEQ 227, in complement
attccatcacccagtttc

SEQ ID NO: 8093 - DNA, 18 bp, Homo Sapiens
  primer_bind 1..18: downstream amplification primer 99-1362 for SEQ 228, in complement
atacgcacaagccataac

SEQ ID NO: 8094 - DNA, 18 bp, Homo Sapiens
  primer_bind 1..18: downstream amplification primer 99-13624 for SEQ 229, in complement
gactaagccagaatctcc

SEQ ID NO: 8095 - DNA, 21 bp, Homo Sapiens
  primer_bind 1..21: downstream amplification primer 99-13638 for SEQ 230, in complement
ttacaaaataggtttcagcag

SEQ ID NO: 8096 - DNA, 18 bp, Homo Sapiens
  primer_bind 1..18: downstream amplification primer 99-13644 for SEQ 231, in complement
tttctgtctggcaacttc

SEQ ID NO: 8097 - DNA, 20 bp, Homo Sapiens
  primer_bind 1..20: downstream amplification primer 99-13647 for SEQ 232, in complement
tggtcattgtcccttatgtc

SEQ ID NO: 8098 - DNA, 21 bp, Homo Sapiens
  primer_bind 1..21: downstream amplification primer 99-13652 for SEQ 233, in complement
ttttttagttgggaggatggg

SEQ ID NO: 8099 - DNA, 21 bp, Homo Sapiens
  primer_bind 1..21: downstream amplification primer 99-13663 for SEQ 234, in complement
ctgagatgtccacaattctac

SEQ ID NO: 8100 - DNA, 21 bp, Homo Sapiens
  primer_bind 1..21: downstream amplification primer 99-13666 for SEQ 235, in complement
taggagactgcaaatcatctg

SEQ ID NO: 8101 - DNA, 20 bp, Homo Sapiens
  primer_bind 1..20: downstream amplification primer 99-1367 for SEQ 236, in complement
cctcttttttggttttcctc

SEQ ID NO: 8102 - DNA, 21 bp, Homo Sapiens
  primer_bind 1..21: downstream amplification primer 99-13671 for SEQ 237, in complement
tggctatttctggaagatgag

SEQ ID NO: 8103 - DNA, 21 bp, Homo Sapiens
  primer_bind 1..21: downstream amplification primer 99-13678 for SEQ 238, in complement
caagattttcagtaagggctc

SEQ ID NO: 8104 - DNA, 21 bp, Homo Sapiens
  primer_bind 1..21: downstream amplification primer 99-13679 for SEQ 239, in complement
attttgtgtgtattagggtgg

SEQ ID NO: 8105 - DNA, 19 bp, Homo Sapiens
  primer_bind 1..19: downstream amplification primer 99-1368 for SEQ 240, in complement
atacctacaagtggtattc

SEQ ID NO: 8106 - DNA, 21 bp, Homo Sapiens
  primer_bind 1..21: downstream amplification primer 99-13684 for SEQ 241, in complement
agacaggagtaggtttgaaag

SEQ ID NO: 8107 - DNA, 21 bp, Homo Sapiens
  primer_bind 1..21: downstream amplification primer 99-13687 for SEQ 242, in complement
tcggaatctcttatctcaggg

SEQ ID NO: 8108 - DNA, 18 bp, Homo Sapiens
  primer_bind 1..18: downstream amplification primer 99-1373 for SEQ 243, in complement
agttgtctctgtggaagg

SEQ ID NO: 8109 - DNA, 21 bp, Homo Sapiens
  primer_bind 1..21: downstream amplification primer 99-1376 for SEQ 244, in complement
acaaatagactgaacttggac

SEQ ID NO: 8110 - DNA, 21 bp, Homo Sapiens
  primer_bind 1..21: downstream amplification primer 99-13790 for SEQ 245, in complement
aatcaatcaatccctcacttc

SEQ ID NO: 8111 - DNA, 21 bp, Homo Sapiens
  primer_bind 1..21: downstream amplification primer 99-13798 for SEQ 246, in complement
atgcttcttacgtgtgctagg

SEQ ID NO: 8112 - DNA, 21 bp, Homo Sapiens
  primer_bind 1..21: downstream amplification primer 99-13831 for SEQ 247, in complement
gtaattgtccttaaagcagtg

SEQ ID NO: 8113 - DNA, 21 bp, Homo Sapiens
  primer_bind 1..21: downstream amplification primer 99-13832 for SEQ 248, in complement
agaatcttgctttcagaggtg

SEQ ID NO: 8114 - DNA, 21 bp, Homo Sapiens
  primer_bind 1..21: downstream amplification primer 99-13835 for SEQ 249, in complement
tacctctctatggacttcaac

SEQ ID NO: 8115 - DNA, 21 bp, Homo Sapiens
  primer_bind 1..21: downstream amplification primer 99-1385 for SEQ 250, in complement
atatagacctctttaggggac

SEQ ID NO: 8116 - DNA, 18 bp, Homo Sapiens
  primer_bind 1..18: downstream amplification primer 99-13853 for SEQ 251, in complement
tgattctcagggtcattg

SEQ ID NO: 8117 - DNA, 21 bp, Homo Sapiens
  primer_bind 1..21: downstream amplification primer 99-13854 for SEQ 252, in complement
tagcaatatcatcccaggcag

SEQ ID NO: 8118 - DNA, 21 bp, Homo Sapiens
  primer_bind 1..21: downstream amplification primer 99-13860 for SEQ 253, in complement
atcacagattgaggttgtcag

SEQ ID NO: 8119 - DNA, 21 bp, Homo Sapiens
  primer_bind 1..21: downstream amplification primer 99-13861 for SEQ 254, in complement
tttgaaatcttgcttatgtcc

SEQ ID NO: 8120 - DNA, 20 bp, Homo Sapiens
  primer_bind 1..20: downstream amplification primer 99-13866 for SEQ 255, in complement
tcagaaccgcatccctgttg

SEQ ID NO: 8121 - DNA, 21 bp, Homo Sapiens
  primer_bind 1..21: downstream amplification primer 99-13868 for SEQ 256, in complement
atgtcttaatagttcagcagg

SEQ ID NO: 8122 - DNA, 19 bp, Homo Sapiens
  primer_bind 1..19: downstream amplification primer 99-1387 for SEQ 257, in complement
cctttcttttactctccac

SEQ ID NO: 8123 - DNA, 18 bp, Homo Sapiens
  primer_bind 1..18: downstream amplification primer 99-13876 for SEQ 258, in complement
cagaatgtgggtaaagag

SEQ ID NO: 8124 - DNA, 21 bp, Homo Sapiens
  primer_bind 1..21: downstream amplification primer 99-13878 for SEQ 259, in complement
ttattatgggggagtgtaaag

SEQ ID NO: 8125 - DNA, 21 bp, Homo Sapiens
  primer_bind 1..21: downstream amplification primer 99-1388 for SEQ 260, in complement
taaaatgtattagggtgtctg

SEQ ID NO: 8126 - DNA, 21 bp, Homo Sapiens
  primer_bind 1..21: downstream amplification primer 99-13880 for SEQ 261, in complement
ggcaatagatagcaaatccag

SEQ ID NO: 8127 - DNA, 21 bp, Homo Sapiens
  primer_bind 1..21: downstream amplification primer 99-13883 for SEQ 262, in complement
tttctccctcttgaacctcac

SEQ ID NO: 8128 - DNA, 18 bp, Homo Sapiens
  primer_bind 1..18: downstream amplification primer 99-13887 for SEQ 263, in complement
tccatgcacagatactac

SEQ ID NO: 8129 - DNA, 20 bp, Homo Sapiens
  primer_bind 1..20: downstream amplification primer 99-13888 for SEQ 264, in complement
catgtgcatgtgtcttcagg

SEQ ID NO: 8130 - DNA, 18 bp, Homo Sapiens
  primer_bind 1..18: downstream amplification primer 99-13892 for SEQ 265, in complement
ccagtattcaacagcacc

SEQ ID NO: 8131 - DNA, 21 bp, Homo Sapiens
  primer_bind 1..21: downstream amplification primer 99-13897 for SEQ 266, in complement
aaacagagagagaaggaacac

SEQ ID NO: 8132 - DNA, 21 bp, Homo Sapiens
  primer_bind 1..21: downstream amplification primer 99-1391 for SEQ 267, in complement
ttcatctactagaatgttgtc

SEQ ID NO: 8133 - DNA, 19 bp, Homo Sapiens
  primer_bind 1..19: downstream amplification primer 99-13912 for SEQ 268, in complement
gcagaaaactctatcatcg

SEQ ID NO: 8134 - DNA, 20 bp, Homo Sapiens
  primer_bind 1..20: downstream amplification primer 99-13913 for SEQ 269, in complement
cctacgattgcactaagctc

SEQ ID NO: 8135 - DNA, 18 bp, Homo Sapiens
  primer_bind 1..18: downstream amplification primer 99-13914 for SEQ 270, in complement
aattgtccccatcttctc

SEQ ID NO: 8136 - DNA, 21 bp, Homo Sapiens
  primer_bind 1..21: downstream amplification primer 99-1392 for SEQ 271, in complement
ttggggtcttattagtaaagg

SEQ ID NO: 8137 - DNA, 19 bp, Homo Sapiens
  primer_bind 1..19: downstream amplification primer 99-13920 for SEQ 272, in complement
ttcaaggagtggctcatgc

SEQ ID NO: 8138 - DNA, 21 bp, Homo Sapiens
  primer_bind 1..21: downstream amplification primer 99-13925 for SEQ 273, in complement
caaatgaaattgtgaacttgg

SEQ ID NO: 8139 - DNA, 21 bp, Homo Sapiens
  primer_bind 1..21: downstream amplification primer 99-13929 for SEQ 274, in complement
gagatatgcaaatcatctgtg

SEQ ID NO: 8140 - DNA, 21 bp, Homo Sapiens
  primer_bind 1..21: downstream amplification primer 99-13932 for SEQ 275, in complement
cctggggaaaaagtagcaaac

SEQ ID NO: 8141 - DNA, 19 bp, Homo Sapiens
  primer_bind 1..19: downstream amplification primer 99-1394 for SEQ 276, in complement
gtgccatttaatgagatag

SEQ ID NO: 8142 - DNA, 18 bp, Homo Sapiens
  primer_bind 1..18: downstream amplification primer 99-13956 for SEQ 277, in complement
gaagggattgtgtggaag

SEQ ID NO: 8143 - DNA, 21 bp, Homo Sapiens
  primer_bind 1..21: downstream amplification primer 99-13960 for SEQ 278, in complement
tgaagtgagagttgagcccag

SEQ ID NO: 8144 - DNA, 21 bp, Homo Sapiens
  primer_bind 1..21: downstream amplification primer 99-13962 for SEQ 279, in complement
gagtgaattgggattgttttg

SEQ ID NO: 8145 - DNA, 21 bp, Homo Sapiens
  primer_bind 1..21: downstream amplification primer 99-13980 for SEQ 280, in complement
tatctcccttaccctcttccc

SEQ ID NO: 8146 - DNA, 21 bp, Homo Sapiens
  primer_bind 1..21: downstream amplification primer 99-13996 for SEQ 281, in complement
gctgctgtgaatattttagac

SEQ ID NO: 8147 - DNA, 20 bp, Homo Sapiens
  primer_bind 1..20: downstream amplification primer 99-13997 for SEQ 282, in complement
tgccagtccagttgtttgcc

SEQ ID NO: 8148 - DNA, 21 bp, Homo Sapiens
  primer_bind 1..21: downstream amplification primer 99-13998 for SEQ 283, in complement
agtcaaatgtagtcagaaagc

SEQ ID NO: 8149 - DNA, 21 bp, Homo Sapiens
  primer_bind 1..21: downstream amplification primer 99-140 for SEQ 284, in complement
gaacaaccttgaattagcttg

SEQ ID NO: 8150 - DNA, 21 bp, Homo Sapiens
  primer_bind 1..21: downstream amplification primer 99-14004 for SEQ 285, in complement
ggtgttctagtgcaaatagtc

SEQ ID NO: 8151 - DNA, 19 bp, Homo Sapiens
  primer_bind 1..19: downstream amplification primer 99-14005 for SEQ 286, in complement
actattcacaggcacagtc

SEQ ID NO: 8152 - DNA, 20 bp, Homo Sapiens
  primer_bind 1..20: downstream amplification primer 99-14009 for SEQ 287, in complement
ctacaccaataccattactc

SEQ ID NO: 8153 - DNA, 21 bp, Homo Sapiens
  primer_bind 1..21: downstream amplification primer 99-14010 for SEQ 288, in complement
actaaaagtagtgctggtgtc

SEQ ID NO: 8154 - DNA, 21 bp, Homo Sapiens
  primer_bind 1..21: downstream amplification primer 99-14013 for SEQ 289, in complement
gatttagagatgtgagagatg

SEQ ID NO: 8155 - DNA, 21 bp, Homo Sapiens
  primer_bind 1..21: downstream amplification primer 99-14025 for SEQ 290, in complement
ggaagacaattttagggaaac

SEQ ID NO: 8156 - DNA, 21 bp, Homo Sapiens
  primer_bind 1..21: downstream amplification primer 99-1404 for SEQ 291, in complement
gttgaagatttttgatttccc

SEQ ID NO: 8157 - DNA, 18 bp, Homo Sapiens
  primer_bind 1..18: downstream amplification primer 99-14046 for SEQ 292, in complement
gtgatggtgatggtgatg

SEQ ID NO: 8158 - DNA, 21 bp, Homo Sapiens
  primer_bind 1..21: downstream amplification primer 99-14050 for SEQ 293, in complement
aaaaaactgatgaaacccaac

SEQ ID NO: 8159 - DNA, 21 bp, Homo Sapiens
  primer_bind 1..21: downstream amplification primer 99-14068 for SEQ 294, in complement
caagaagttatgtatctgtcc

SEQ ID NO: 8160 - DNA, 21 bp, Homo Sapiens
  primer_bind 1..21: downstream amplification primer 99-14072 for SEQ 295, in complement
aataatctttctccactgcac

SEQ ID NO: 8161 - DNA, 18 bp, Homo Sapiens
  primer_bind 1..18: downstream amplification primer 99-14080 for SEQ 296, in complement
gaactgaacagagactcc

SEQ ID NO: 8162 - DNA, 18 bp, Homo Sapiens
  primer_bind 1..18: downstream amplification primer 99-14083 for SEQ 297, in complement
ctgttccctttcctgatg

SEQ ID NO: 8163 - DNA, 21 bp, Homo Sapiens
  primer_bind 1..21: downstream amplification primer 99-14087 for SEQ 298, in complement
cacattccacccttcttcatc

SEQ ID NO: 8164 - DNA, 20 bp, Homo Sapiens
  primer_bind 1..20: downstream amplification primer 99-14090 for SEQ 299, in complement
gaaaggataaaggaaggaag

SEQ ID NO: 8165 - DNA, 21 bp, Homo Sapiens
  primer_bind 1..21: downstream amplification primer 99-14094 for SEQ 300, in complement
cttaaaacaagctgaagaatc

SEQ ID NO: 8166 - DNA, 18 bp, Homo Sapiens
  primer_bind 1..18: downstream amplification primer 99-14119 for SEQ 301, in complement
accaagattccttaccag

SEQ ID NO: 8167 - DNA, 18 bp, Homo Sapiens
  primer_bind 1..18: downstream amplification primer 99-14120 for SEQ 302, in complement
tcgcctgaaaatagagtg

SEQ ID NO: 8168 - DNA, 20 bp, Homo Sapiens
  primer_bind 1..20: downstream amplification primer 99-14127 for SEQ 303, in complement
tcacgtctgtaaaaaatgtc

SEQ ID NO: 8169 - DNA, 20 bp, Homo Sapiens
  primer_bind 1..20: downstream amplification primer 99-1413 for SEQ 304, in complement
ttggttttgtgaactgatgg

SEQ ID NO: 8170 - DNA, 20 bp, Homo Sapiens
  primer_bind 1..20: downstream amplification primer 99-14135 for SEQ 305, in complement
accttctctctccctccaac

SEQ ID NO: 8171 - DNA, 21 bp, Homo Sapiens
  primer_bind 1..21: downstream amplification primer 99-14139 for SEQ 306, in complement
taaattttacacagaagcacc

SEQ ID NO: 8172 - DNA, 21 bp, Homo Sapiens
  primer_bind 1..21: downstream amplification primer 99-14140 for SEQ 307, in complement
gcaaggtaattcatcagaagg

SEQ ID NO: 8173 - DNA, 18 bp, Homo Sapiens
  primer_bind 1..18: downstream amplification primer 99-14145 for SEQ 308, in complement
acaagcctggaaaggaac

SEQ ID NO: 8174 - DNA, 21 bp, Homo Sapiens
  primer_bind 1..21: downstream amplification primer 99-14147 for SEQ 309, in complement
ttacttttgcttagtttgctc

SEQ ID NO: 8175 - DNA, 21 bp, Homo Sapiens
  primer_bind 1..21: downstream amplification primer 99-14149 for SEQ 310, in complement
gttaaataatggagagatggg

SEQ ID NO: 8176 - DNA, 21 bp, Homo Sapiens
  primer_bind 1..21: downstream amplification primer 99-1416 for SEQ 311, in complement
gagatgttacagataattcag

SEQ ID NO: 8177 - DNA, 18 bp, Homo Sapiens
  primer_bind 1..18: downstream amplification primer 99-14161 for SEQ 312, in complement
attggctctttcaggttc

SEQ ID NO: 8178 - DNA, 20 bp, Homo Sapiens
  primer_bind 1..20: downstream amplification primer 99-14162 for SEQ 313, in complement
tctaagtctaagtttgcagg

SEQ ID NO: 8179 - DNA, 20 bp, Homo Sapiens
  primer_bind 1..20: downstream amplification primer 99-14166 for SEQ 314, in complement
gtaatgtaagaccaagacag

SEQ ID NO: 8180 - DNA, 18 bp, Homo Sapiens
  primer_bind 1..18: downstream amplification primer 99-14175 for SEQ 315, in complement
gtaagcacaactctgacc

SEQ ID NO: 8181 - DNA, 21 bp, Homo Sapiens
  primer_bind 1..21: downstream amplification primer 99-14179 for SEQ 316, in complement
agaactttccccatcccagac

SEQ ID NO: 8182 - DNA, 18 bp, Homo Sapiens
  primer_bind 1..18: downstream amplification primer 99-14186 for SEQ 317, in complement
tctacatctcctgttgac

SEQ ID NO: 8183 - DNA, 18 bp, Homo Sapiens
  primer_bind 1..18: downstream amplification primer 99-14197 for SEQ 318, in complement
atgttctcgcttagggtg

SEQ ID NO: 8184 - DNA, 21 bp, Homo Sapiens
  primer_bind 1..21: downstream amplification primer 99-14203 for SEQ 319, in complement
aaaaccacgaaactgaccaac

SEQ ID NO: 8185 - DNA, 21 bp, Homo Sapiens
  primer_bind 1..21: downstream amplification primer 99-14204 for SEQ 320, in complement
ctcttcctctcttactacatc

SEQ ID NO: 8186 - DNA, 18 bp, Homo Sapiens
  primer_bind 1..18: downstream amplification primer 99-14220 for SEQ 321, in complement
gggataagcaaccaagac

SEQ ID NO: 8187 - DNA, 18 bp, Homo Sapiens
  primer_bind 1..18: downstream amplification primer 99-1423 for SEQ 322, in complement
aggaagactttgtcatcg

SEQ ID NO: 8188 - DNA, 21 bp, Homo Sapiens
  primer_bind 1..21: downstream amplification primer 99-14250 for SEQ 323, in complement
taaccagaccacttcatttcc

SEQ ID NO: 8189 - DNA, 21 bp, Homo Sapiens
  primer_bind 1..21: downstream amplification primer 99-14254 for SEQ 324, in complement
ttaatcagtgcttttctcttc

SEQ ID NO: 8190 - DNA, 18 bp, Homo Sapiens
  primer_bind 1..18: downstream amplification primer 99-14256 for SEQ 325, in complement
tgtggaagtgggcagtag

SEQ ID NO: 8191 - DNA, 19 bp, Homo Sapiens
  primer_bind 1..19: downstream amplification primer 99-1426 for SEQ 326, in complement
tttgcagggatgacgaaag

SEQ ID NO: 8192 - DNA, 19 bp, Homo Sapiens
  primer_bind 1..19: downstream amplification primer 99-14260 for SEQ 327, in complement
acccttcattaaatcagtc

SEQ ID NO: 8193 - DNA, 21 bp, Homo Sapiens
  primer_bind 1..21: downstream amplification primer 99-14277 for SEQ 328, in complement
catgaagttgtcaggatgagg

SEQ ID NO: 8194 - DNA, 21 bp, Homo Sapiens
  primer_bind 1..21: downstream amplification primer 99-14282 for SEQ 329, in complement
aaaaagttgctgactcctggc

SEQ ID NO: 8195 - DNA, 21 bp, Homo Sapiens
  primer_bind 1..21: downstream amplification primer 99-14285 for SEQ 330, in complement
cgatccatgcctcctcattac

SEQ ID NO: 8196 - DNA, 21 bp, Homo Sapiens
  primer_bind 1..21: downstream amplification primer 99-14286 for SEQ 331, in complement
gcacatacattacctggtctg

SEQ ID NO: 8197 - DNA, 21 bp, Homo Sapiens
  primer_bind 1..21: downstream amplification primer 99-14309 for SEQ 332, in complement
aagagaagcagagtgcaggac

SEQ ID NO: 8198 - DNA, 21 bp, Homo Sapiens
  primer_bind 1..21: downstream amplification primer 99-14315 for SEQ 333, in complement
agttcctctttcagttgttcc

SEQ ID NO: 8199 - DNA, 21 bp, Homo Sapiens
  primer_bind 1..21: downstream amplification primer 99-14329 for SEQ 334, in complement
ctcaactgctctcaataccac

SEQ ID NO: 8200 - DNA, 20 bp, Homo Sapiens
  primer_bind 1..20: downstream amplification primer 99-14331 for SEQ 335, in complement
attcactcctacatccaatg

SEQ ID NO: 8201 - DNA, 21 bp, Homo Sapiens
  primer_bind 1..21: downstream amplification primer 99-14332 for SEQ 336, in complement
ggatgaaaaggtaaagaacag

SEQ ID NO: 8202 - DNA, 18 bp, Homo Sapiens
  primer_bind 1..18: downstream amplification primer 99-14343 for SEQ 337, in complement
tcctttactctagtcctg

SEQ ID NO: 8203 - DNA, 21 bp, Homo Sapiens
  primer_bind 1..21: downstream amplification primer 99-14345 for SEQ 338, in complement
tcaacctttggaccctgagac

SEQ ID NO: 8204 - DNA, 21 bp, Homo Sapiens
  primer_bind 1..21: downstream amplification primer 99-14356 for SEQ 339, in complement
gataatagggaagaagaaaac

SEQ ID NO: 8205 - DNA, 21 bp, Homo Sapiens
  primer_bind 1..21: downstream amplification primer 99-1437 for SEQ 340, in complement
attctcattctctcattttcc

SEQ ID NO: 8206 - DNA, 20 bp, Homo Sapiens
  primer_bind 1..20: downstream amplification primer 99-14385 for SEQ 341, in complement
tctcttgttacccctgcctc

SEQ ID NO: 8207 - DNA, 21 bp, Homo Sapiens
  primer_bind 1..21: downstream amplification primer 99-14392 for SEQ 342, in complement
ctgtaccctttacaacctctc

SEQ ID NO: 8208 - DNA, 20 bp, Homo Sapiens
  primer_bind 1..20: downstream amplification primer 99-14393 for SEQ 343, in complement
aatgccagatagtcttattg

SEQ ID NO: 8209 - DNA, 18 bp, Homo Sapiens
  primer_bind 1..18: downstream amplification primer 99-144 for SEQ 344, in complement
atgaggtagtgggaattg

SEQ ID NO: 8210 - DNA, 21 bp, Homo Sapiens
  primer_bind 1..21: downstream amplification primer 99-14405 for SEQ 345, in complement
aaattaccatccctgtggctc

SEQ ID NO: 8211 - DNA, 19 bp, Homo Sapiens
  primer_bind 1..19: downstream amplification primer 99-1442 for SEQ 346, in complement
aataaaggtcacaaggaac

SEQ ID NO: 8212 - DNA, 21 bp, Homo Sapiens
  primer_bind 1..21: downstream amplification primer 99-14444 for SEQ 347, in complement
gcagaatatttggagtcagag

SEQ ID NO: 8213 - DNA, 18 bp, Homo Sapiens
  primer_bind 1..18: downstream amplification primer 99-14446 for SEQ 348, in complement
gtggcaatgcagttaatc

SEQ ID NO: 8214 - DNA, 21 bp, Homo Sapiens
  primer_bind 1..21: downstream amplification primer 99-14452 for SEQ 349, in complement
acacacatacagagagaacac

SEQ ID NO: 8215 - DNA, 18 bp, Homo Sapiens
  primer_bind 1..18: downstream amplification primer 99-14459 for SEQ 350, in complement
tgtggttgtgagatagag

SEQ ID NO: 8216 - DNA, 20 bp, Homo Sapiens
  primer_bind 1..20: downstream amplification primer 99-14468 for SEQ 351, in complement
atgaattatctggtgccagc

SEQ ID NO: 8217 - DNA, 19 bp, Homo Sapiens
  primer_bind 1..19: downstream amplification primer 99-14470 for SEQ 352, in complement
agaattttgagttgagagg

SEQ ID NO: 8218 - DNA, 18 bp, Homo Sapiens
  primer_bind 1..18: downstream amplification primer 99-14492 for SEQ 353, in complement
caagagaggagactgttg

SEQ ID NO: 8219 - DNA, 21 bp, Homo Sapiens
  primer_bind 1..21: downstream amplification primer 99-14497 for SEQ 354, in complement
gtaaaaaagagaggcagtgac

SEQ ID NO: 8220 - DNA, 20 bp, Homo Sapiens
  primer_bind 1..20: downstream amplification primer 99-14505 for SEQ 355, in complement
ccccaagtctgtgcttagtc

SEQ ID NO: 8221 - DNA, 20 bp, Homo Sapiens
  primer_bind 1..20: downstream amplification primer 99-14518 for SEQ 356, in complement
gacagcaattagagatggac

SEQ ID NO: 8222 - DNA, 19 bp, Homo Sapiens
  primer_bind 1..19: downstream amplification primer 99-1453 for SEQ 357, in complement
ctggaggtattagttgatg

SEQ ID NO: 8223 - DNA, 18 bp, Homo Sapiens
  primer_bind 1..18: downstream amplification primer 99-14553 for SEQ 358, in complement
gaacagggagagataaac

SEQ ID NO: 8224 - DNA, 18 bp, Homo Sapiens
  primer_bind 1..18: downstream amplification primer 99-14562 for SEQ 359, in complement
caaaagacaggtaacagg

SEQ ID NO: 8225 - DNA, 21 bp, Homo Sapiens
  primer_bind 1..21: downstream amplification primer 99-14566 for SEQ 360, in complement
gatgaactttgtgaattactg

SEQ ID NO: 8226 - DNA, 20 bp, Homo Sapiens
  primer_bind 1..20: downstream amplification primer 99-14574 for SEQ 361, in complement
cacaaagctgcaaggctaac

SEQ ID NO: 8227 - DNA, 19 bp, Homo Sapiens
  primer_bind 1..19: downstream amplification primer 99-14581 for SEQ 362, in complement
agctctccacaggaaagac

SEQ ID NO: 8228 - DNA, 21 bp, Homo Sapiens
  primer_bind 1..21: downstream amplification primer 99-14591 for SEQ 363, in complement
tttagatggggataaatgttg

SEQ ID NO: 8229 - DNA, 18 bp, Homo Sapiens
  primer_bind 1..18: downstream amplification primer 99-14595 for SEQ 364, in complement
cttccgtgtctcttgttg

SEQ ID NO: 8230 - DNA, 18 bp, Homo Sapiens
  primer_bind 1..18: downstream amplification primer 99-14596 for SEQ 365, in complement
acccacggaaactatcag

SEQ ID NO: 8231 - DNA, 21 bp, Homo Sapiens
  primer_bind 1..21: downstream amplification primer 99-14597 for SEQ 366, in complement
gcactggggaaaatgacaatg

SEQ ID NO: 8232 - DNA, 21 bp, Homo Sapiens
  primer_bind 1..21: downstream amplification primer 99-14598 for SEQ 367, in complement
gcaataaaaccctgtaacacg

SEQ ID NO: 8233 - DNA, 19 bp, Homo Sapiens
  primer_bind 1..19: downstream amplification primer 99-14599 for SEQ 368, in complement
aaacgcagcagcacttacc

SEQ ID NO: 8234 - DNA, 20 bp, Homo Sapiens
  primer_bind 1..20: downstream amplification primer 99-14600 for SEQ 369, in complement
gatttgttgttagtatgtcc

SEQ ID NO: 8235 - DNA, 21 bp, Homo Sapiens
  primer_bind 1..21: downstream amplification primer 99-14601 for SEQ 370, in complement
agcagatactacttatgaaac

SEQ ID NO: 8236 - DNA, 20 bp, Homo Sapiens
  primer_bind 1..20: downstream amplification primer 99-14607 for SEQ 371, in complement
ccagtggcagcagataaacg

SEQ ID NO: 8237 - DNA, 20 bp, Homo Sapiens
  primer_bind 1..20: downstream amplification primer 99-14609 for SEQ 372, in complement
tgttaagtctattaccagtg

SEQ ID NO: 8238 - DNA, 21 bp, Homo Sapiens
  primer_bind 1..21: downstream amplification primer 99-14610 for SEQ 373, in complement
aggatggtgatgaaatacaag

SEQ ID NO: 8239 - DNA, 21 bp, Homo Sapiens
  primer_bind 1..21: downstream amplification primer 99-14611 for SEQ 374, in complement
tattttgattgaccactcacc

SEQ ID NO: 8240 - DNA, 21 bp, Homo Sapiens
  primer_bind 1..21: downstream amplification primer 99-14612 for SEQ 375, in complement
aaatcttctcagagattctcc

SEQ ID NO: 8241 - DNA, 19 bp, Homo Sapiens
  primer_bind 1..19: downstream amplification primer 99-14614 for SEQ 376, in complement
ttttcaccacatctaacac

SEQ ID NO: 8242 - DNA, 20 bp, Homo Sapiens
  primer_bind 1..20: downstream amplification primer 99-14615 for SEQ 377, in complement
ctattctaatctcttctcag

SEQ ID NO: 8243 - DNA, 20 bp, Homo Sapiens
  primer_bind 1..20: downstream amplification primer 99-14616 for SEQ 378, in complement
atcactggtttctatgacac

SEQ ID NO: 8244 - DNA, 19 bp, Homo Sapiens
  primer_bind 1..19: downstream amplification primer 99-14618 for SEQ 379, in complement
tctgaagtgcttatatgag

SEQ ID NO: 8245 - DNA, 21 bp, Homo Sapiens
  primer_bind 1..21: downstream amplification primer 99-14619 for SEQ 380, in complement
cacatactaactcataacttc

SEQ ID NO: 8246 - DNA, 21 bp, Homo Sapiens
  primer_bind 1..21: downstream amplification primer 99-1462 for SEQ 381, in complement
gattccagaagtccatttcag

SEQ ID NO: 8247 - DNA, 21 bp, Homo Sapiens
  primer_bind 1..21: downstream amplification primer 99-14620 for SEQ 382, in complement
aaccaactatttgccatttag

SEQ ID NO: 8248 - DNA, 21 bp, Homo Sapiens
  primer_bind 1..21: downstream amplification primer 99-14621 for SEQ 383, in complement
gatactaaatcctgaatcacc

SEQ ID NO: 8249 - DNA, 21 bp, Homo Sapiens
  primer_bind 1..21: downstream amplification primer 99-14622 for SEQ 384, in complement
atagttgatatggtgattgtg

SEQ ID NO: 8250 - DNA, 20 bp, Homo Sapiens
  primer_bind 1..20: downstream amplification primer 99-14626 for SEQ 385, in complement
cataatcttgtgaatactgg

SEQ ID NO: 8251 - DNA, 19 bp, Homo Sapiens
  primer_bind 1..19: downstream amplification primer 99-14627 for SEQ 386, in complement
gagtttgcttgcttgatac

SEQ ID NO: 8252 - DNA, 21 bp, Homo Sapiens
  primer_bind 1..21: downstream amplification primer 99-14628 for SEQ 387, in complement
catctataactacttgtatcc

SEQ ID NO: 8253 - DNA, 21 bp, Homo Sapiens
  primer_bind 1..21: downstream amplification primer 99-14629 for SEQ 388, in complement
ggtgctttagtcaccattgag

SEQ ID NO: 8254 - DNA, 21 bp, Homo Sapiens
  primer_bind 1..21: downstream amplification primer 99-14630 for SEQ 389, in complement
taagtaggcagcagaacccag

SEQ ID NO: 8255 - DNA, 21 bp, Homo Sapiens
  primer_bind 1..21: downstream amplification primer 99-14634 for SEQ 390, in complement
cagagaagacaagagctgagg

SEQ ID NO: 8256 - DNA, 21 bp, Homo Sapiens
  primer_bind 1..21: downstream amplification primer 99-14635 for SEQ 391, in complement
cgtcagaacataatagagttg

SEQ ID NO: 8257 - DNA, 21 bp, Homo Sapiens
  primer_bind 1..21: downstream amplification primer 99-14637 for SEQ 392, in complement
agaatcagcaaaaacagccag

SEQ ID NO: 8258 - DNA, 21 bp, Homo Sapiens
  primer_bind 1..21: downstream amplification primer 99-14638 for SEQ 393, in complement
tgtgtatcagtcacaggtgag

SEQ ID NO: 8259 - DNA, 21 bp, Homo Sapiens
  primer_bind 1..21: downstream amplification primer 99-14643 for SEQ 394, in complement
gtttgttccttctgtgaggtg

SEQ ID NO: 8260 - DNA, 21 bp, Homo Sapiens
  primer_bind 1..21: downstream amplification primer 99-14644 for SEQ 395, in complement
ttggaaaaagggattagatac

SEQ ID NO: 8261 - DNA, 21 bp, Homo Sapiens
  primer_bind 1..21: downstream amplification primer 99-14647 for SEQ 396, in complement
acatcattctacacatctccc

SEQ ID NO: 8262 - DNA, 18 bp, Homo Sapiens
  primer_bind 1..18: downstream amplification primer 99-14651 for SEQ 397, in complement
gctttcgtattggttagg

SEQ ID NO: 8263 - DNA, 21 bp, Homo Sapiens
  primer_bind 1..21: downstream amplification primer 99-14652 for SEQ 398, in complement
aacacatcttgtccacagttc

SEQ ID NO: 8264 - DNA, 21 bp, Homo Sapiens
  primer_bind 1..21: downstream amplification primer 99-14653 for SEQ 399, in complement
tcactcagaattgaaccttcc

SEQ ID NO: 8265 - DNA, 21 bp, Homo Sapiens
  primer_bind 1..21: downstream amplification primer 99-14662 for SEQ 400, in complement
aggttatgactcagatatagg

SEQ ID NO: 8266 - DNA, 21 bp, Homo Sapiens
  primer_bind 1..21: downstream amplification primer 99-14664 for SEQ 401, in complement
gagccactctttcctttcacc

SEQ ID NO: 8267 - DNA, 20 bp, Homo Sapiens
  primer_bind 1..20: downstream amplification primer 99-14665 for SEQ 402, in complement
gctatttgaagaggtaagag

SEQ ID NO: 8268 - DNA, 20 bp, Homo Sapiens
  primer_bind 1..20: downstream amplification primer 99-14669 for SEQ 403, in complement
ctatatcactctttcttgtc

SEQ ID NO: 8269 - DNA, 19 bp, Homo Sapiens
  primer_bind 1..19: downstream amplification primer 99-14671 for SEQ 404, in complement
tttagttcatcgttggaag

SEQ ID NO: 8270 - DNA, 21 bp, Homo Sapiens
  primer_bind 1..21: downstream amplification primer 99-14676 for SEQ 405, in complement
cgtgaacacttaacttttgag

SEQ ID NO: 8271 - DNA, 21 bp, Homo Sapiens
  primer_bind 1..21: downstream amplification primer 99-14677 for SEQ 406, in complement
catatttcccttctcaaaatc

SEQ ID NO: 8272 - DNA, 19 bp, Homo Sapiens
  primer_bind 1..19: downstream amplification primer 99-14678 for SEQ 407, in complement
agcaaagccttcctgagag

SEQ ID NO: 8273 - DNA, 20 bp, Homo Sapiens
  primer_bind 1..20: downstream amplification primer 99-14679 for SEQ 408, in complement
aacgtgactctgacaccctc

SEQ ID NO: 8274 - DNA, 19 bp, Homo Sapiens
  primer_bind 1..19: downstream amplification primer 99-1468 for SEQ 409, in complement
cttatagaaacatagcacc

SEQ ID NO: 8275 - DNA, 21 bp, Homo Sapiens
  primer_bind 1..21: downstream amplification primer 99-1469 for SEQ 410, in complement
ttgacaccagaagaaagagac

SEQ ID NO: 8276 - DNA, 21 bp, Homo Sapiens
  primer_bind 1..21: downstream amplification primer 99-14690 for SEQ 411, in complement
ccattcaactttccatctatc

SEQ ID NO: 8277 - DNA, 19 bp, Homo Sapiens
  primer_bind 1..19: downstream amplification primer 99-14692 for SEQ 412, in complement
gcagaaaaatgtacgtttg

SEQ ID NO: 8278 - DNA, 19 bp, Homo Sapiens
  primer_bind 1..19: downstream amplification primer 99-14699 for SEQ 413, in complement
accccaacatccacaactc

SEQ ID NO: 8279 - DNA, 21 bp, Homo Sapiens
  primer_bind 1..21: downstream amplification primer 99-147 for SEQ 414, in complement
aggtaagaatgagcaaaaagg

SEQ ID NO: 8280 - DNA, 21 bp, Homo Sapiens
  primer_bind 1..21: downstream amplification primer 99-14701 for SEQ 415, in complement
caaggtgcttcatttctcttc

SEQ ID NO: 8281 - DNA, 20 bp, Homo Sapiens
  primer_bind 1..20: downstream amplification primer 99-14704 for SEQ 416, in complement
ggtgcttatttatctatgtc

SEQ ID NO: 8282 - DNA, 21 bp, Homo Sapiens
  primer_bind 1..21: downstream amplification primer 99-14708 for SEQ 417, in complement
agacaatggtgtgctgtttgc

SEQ ID NO: 8283 - DNA, 21 bp, Homo Sapiens
  primer_bind 1..21: downstream amplification primer 99-1471 for SEQ 418, in complement
gtatgtgttctttgttttctg

SEQ ID NO: 8284 - DNA, 20 bp, Homo Sapiens
  primer_bind 1..20: downstream amplification primer 99-14710 for SEQ 419, in complement
gtaaggttacattttccagc

SEQ ID NO: 8285 - DNA, 21 bp, Homo Sapiens
  primer_bind 1..21: downstream amplification primer 99-14712 for SEQ 420, in complement
atgctatcttccatatcaaag

SEQ ID NO: 8286 - DNA, 21 bp, Homo Sapiens
  primer_bind 1..21: downstream amplification primer 99-14714 for SEQ 421, in complement
aattgagtgtgggaattaagg

SEQ ID NO: 8287 - DNA, 21 bp, Homo Sapiens
  primer_bind 1..21: downstream amplification primer 99-14717 for SEQ 422, in complement
tatttgcagaggacacttgcc

SEQ ID NO: 8288 - DNA, 20 bp, Homo Sapiens
  primer_bind 1..20: downstream amplification primer 99-1472 for SEQ 423, in complement
tcctatttacttgcttacgc

SEQ ID NO: 8289 - DNA, 21 bp, Homo Sapiens
  primer_bind 1..21: downstream amplification primer 99-14722 for SEQ 424, in complement
agaacagcaagaagcagtcag

SEQ ID NO: 8290 - DNA, 18 bp, Homo Sapiens
  primer_bind 1..18: downstream amplification primer 99-14729 for SEQ 425, in complement
gggtatggcaatcaaatc

SEQ ID NO: 8291 - DNA, 21 bp, Homo Sapiens
  primer_bind 1..21: downstream amplification primer 99-14733 for SEQ 426, in complement
cccttgaacaatataacatcg

SEQ ID NO: 8292 - DNA, 20 bp, Homo Sapiens
  primer_bind 1..20: downstream amplification primer 99-14735 for SEQ 427, in complement
gcgtgttaagatttatagac

SEQ ID NO: 8293 - DNA, 19 bp, Homo Sapiens
  primer_bind 1..19: downstream amplification primer 99-1474 for SEQ 428, in complement
gcttgtgtttgttcaattc

SEQ ID NO: 8294 - DNA, 21 bp, Homo Sapiens
  primer_bind 1..21: downstream amplification primer 99-14746 for SEQ 429, in complement
cttcatgttatagaacacttc

SEQ ID NO: 8295 - DNA, 20 bp, Homo Sapiens
  primer_bind 1..20: downstream amplification primer 99-14753 for SEQ 430, in complement
acctctgtatatcacagatg

SEQ ID NO: 8296 - DNA, 21 bp, Homo Sapiens
  primer_bind 1..21: downstream amplification primer 99-14756 for SEQ 431, in complement
taccttctttcttctgctgac

SEQ ID NO: 8297 - DNA, 19 bp, Homo Sapiens
  primer_bind 1..19: downstream amplification primer 99-1476 for SEQ 432, in complement
ctgactaaagtgataaggg

SEQ ID NO: 8298 - DNA, 21 bp, Homo Sapiens
  primer_bind 1..21: downstream amplification primer 99-14761 for SEQ 433, in complement
gtttgggtggcattctctgac

SEQ ID NO: 8299 - DNA, 21 bp, Homo Sapiens
  primer_bind 1..21: downstream amplification primer 99-14773 for SEQ 434, in complement
cattcttttctcttctctttc

SEQ ID NO: 8300 - DNA, 21 bp, Homo Sapiens
  primer_bind 1..21: downstream amplification primer 99-14776 for SEQ 435, in complement
ctcaaataaactacctatccc

SEQ ID NO: 8301 - DNA, 21 bp, Homo Sapiens
  primer_bind 1..21: downstream amplification primer 99-14777 for SEQ 436, in complement
ttgagacggataattaaacac

SEQ ID NO: 8302 - DNA, 21 bp, Homo Sapiens
  primer_bind 1..21: downstream amplification primer 99-14782 for SEQ 437, in complement
tagcactgaccaattaacaag

SEQ ID NO: 8303 - DNA, 21 bp, Homo Sapiens
  primer_bind 1..21: downstream amplification primer 99-14784 for SEQ 438, in complement
tgggaaaactttagaataagg

SEQ ID NO: 8304 - DNA, 20 bp, Homo Sapiens
  primer_bind 1..20: downstream amplification primer 99-14785 for SEQ 439, in complement
gagtgtccctctccttagtg

SEQ ID NO: 8305 - DNA, 20 bp, Homo Sapiens
  primer_bind 1..20: downstream amplification primer 99-14786 for SEQ 440, in complement
gcctttacgaaacataatcc

SEQ ID NO: 8306 - DNA, 18 bp, Homo Sapiens
  primer_bind 1..18: downstream amplification primer 99-1479 for SEQ 441, in complement
cttgaaatactcccagcc

SEQ ID NO: 8307 - DNA, 21 bp, Homo Sapiens
  primer_bind 1..21: downstream amplification primer 99-14792 for SEQ 442, in complement
tatgaaagcgaaatctaaggg

SEQ ID NO: 8308 - DNA, 21 bp, Homo Sapiens
  primer_bind 1..21: downstream amplification primer 99-14796 for SEQ 443, in complement
cacgttgattttatcagatgg

SEQ ID NO: 8309 - DNA, 21 bp, Homo Sapiens
  primer_bind 1..21: downstream amplification primer 99-14799 for SEQ 444, in complement
aaacaggagagaaggcatcag

SEQ ID NO: 8310 - DNA, 19 bp, Homo Sapiens
  primer_bind 1..19: downstream amplification primer 99-148 for SEQ 445, in complement
ccatgaactgagaactttg

SEQ ID NO: 8311 - DNA, 18 bp, Homo Sapiens
  primer_bind 1..18: downstream amplification primer 99-1480 for SEQ 446, in complement
ggtgacaggtaaagaaac

SEQ ID NO: 8312 - DNA, 19 bp, Homo Sapiens
  primer_bind 1..19: downstream amplification primer 99-14802 for SEQ 447, in complement
ttttatcagcataggtcag

SEQ ID NO: 8313 - DNA, 21 bp, Homo Sapiens
  primer_bind 1..21: downstream amplification primer 99-14803 for SEQ 448, in complement
atgagtcatagattatcacag

SEQ ID NO: 8314 - DNA, 21 bp, Homo Sapiens
  primer_bind 1..21: downstream amplification primer 99-14804 for SEQ 449, in complement
catatttatgacccaagtaag

SEQ ID NO: 8315 - DNA, 21 bp, Homo Sapiens
  primer_bind 1..21: downstream amplification primer 99-14805 for SEQ 450, in complement
atgaatgagatgccaatgtcc

SEQ ID NO: 8316 - DNA, 20 bp, Homo Sapiens
  primer_bind 1..20: downstream amplification primer 99-14806 for SEQ 451, in complement
tccccaccagaatggatcac

SEQ ID NO: 8317 - DNA, 21 bp, Homo Sapiens
  primer_bind 1..21: downstream amplification primer 99-14807 for SEQ 452, in complement
ttgcgaatggaagtggacttg

SEQ ID NO: 8318 - DNA, 21 bp, Homo Sapiens
  primer_bind 1..21: downstream amplification primer 99-1481 for SEQ 453, in complement
attcaggcacagaagtcatac

SEQ ID NO: 8319 - DNA, 21 bp, Homo Sapiens
  primer_bind 1..21: downstream amplification primer 99-14810 for SEQ 454, in complement
cttctgctctaaccacttctg

SEQ ID NO: 8320 - DNA, 21 bp, Homo Sapiens
  primer_bind 1..21: downstream amplification primer 99-14812 for SEQ 455, in complement
tgctccttttttccacaacag

SEQ ID NO: 8321 - DNA, 21 bp, Homo Sapiens
  primer_bind 1..21: downstream amplification primer 99-14817 for SEQ 456, in complement
cgaaaccatgttgaacattac

SEQ ID NO: 8322 - DNA, 21 bp, Homo Sapiens
  primer_bind 1..21: downstream amplification primer 99-14818 for SEQ 457, in complement
aagggcttcattttcaccatc

SEQ ID NO: 8323 - DNA, 21 bp, Homo Sapiens
  primer_bind 1..21: downstream amplification primer 99-14819 for SEQ 458, in complement
ttggaaactgaagactagcac

SEQ ID NO: 8324 - DNA, 20 bp, Homo Sapiens
  primer_bind 1..20: downstream amplification primer 99-14820 for SEQ 459, in complement
tgactcctgctgagagagac

SEQ ID NO: 8325 - DNA, 20 bp, Homo Sapiens
  primer_bind 1..20: downstream amplification primer 99-14821 for SEQ 460, in complement
aggtgagaaaggggggaatg

SEQ ID NO: 8326 - DNA, 21 bp, Homo Sapiens
  primer_bind 1..21: downstream amplification primer 99-14826 for SEQ 461, in complement
acaagggcatatcgcacagag

SEQ ID NO: 8327 - DNA, 21 bp, Homo Sapiens
  primer_bind 1..21: downstream amplification primer 99-14828 for SEQ 462, in complement
agtaacttgcctagataagtg

SEQ ID NO: 8328 - DNA, 21 bp, Homo Sapiens
  primer_bind 1..21: downstream amplification primer 99-14833 for SEQ 463, in complement
tcccttctaggcgttcaactc

SEQ ID NO: 8329 - DNA, 21 bp, Homo Sapiens
  primer_bind 1..21: downstream amplification primer 99-1484 for SEQ 464, in complement
agggcagcacaatgtagtaag

SEQ ID NO: 8330 - DNA, 21 bp, Homo Sapiens
  primer_bind 1..21: downstream amplification primer 99-14843 for SEQ 465, in complement
gtagtagacgcacaggttaag

SEQ ID NO: 8331 - DNA, 21 bp, Homo Sapiens
  primer_bind 1..21: downstream amplification primer 99-14844 for SEQ 466, in complement
aatgctgaaaagaatctggcg

SEQ ID NO: 8332 - DNA, 18 bp, Homo Sapiens
  primer_bind 1..18: downstream amplification primer 99-1485 for SEQ 467, in complement
cctctttatctccaaacc

SEQ ID NO: 8333 - DNA, 20 bp, Homo Sapiens
  primer_bind 1..20: downstream amplification primer 99-14850 for SEQ 468, in complement
cttcaagctcctcttaattc

SEQ ID NO: 8334 - DNA, 21 bp, Homo Sapiens
  primer_bind 1..21: downstream amplification primer 99-14856 for SEQ 469, in complement
aagagtgaatacatttgcacc

SEQ ID NO: 8335 - DNA, 21 bp, Homo Sapiens
  primer_bind 1..21: downstream amplification primer 99-14861 for SEQ 470, in complement
gaaggacacacttgattaagg

SEQ ID NO: 8336 - DNA, 21 bp, Homo Sapiens
  primer_bind 1..21: downstream amplification primer 99-14862 for SEQ 471, in complement
gttgttgtatttggtgttgtg

SEQ ID NO: 8337 - DNA, 21 bp, Homo Sapiens
  primer_bind 1..21: downstream amplification primer 99-14865 for SEQ 472, in complement
ggtaactacacatgatagttc

SEQ ID NO: 8338 - DNA, 20 bp, Homo Sapiens
  primer_bind 1..20: downstream amplification primer 99-14867 for SEQ 473, in complement
tgcaagtagcattcacgcac

SEQ ID NO: 8339 - DNA, 21 bp, Homo Sapiens
  primer_bind 1..21: downstream amplification primer 99-14872 for SEQ 474, in complement
tcatctttcctttctgcctac

SEQ ID NO: 8340 - DNA, 20 bp, Homo Sapiens
  primer_bind 1..20: downstream amplification primer 99-14873 for SEQ 475, in complement
tttgccaacatgaccgtgcc

SEQ ID NO: 8341 - DNA, 18 bp, Homo Sapiens
  primer_bind 1..18: downstream amplification primer 99-14875 for SEQ 476, in complement
agagggggcgatttatag

SEQ ID NO: 8342 - DNA, 21 bp, Homo Sapiens
  primer_bind 1..21: downstream amplification primer 99-14879 for SEQ 477, in complement
ggaagagaagaaaatgtaggg

SEQ ID NO: 8343 - DNA, 21 bp, Homo Sapiens
  primer_bind 1..21: downstream amplification primer 99-14881 for SEQ 478, in complement
accaaatcagtgtttttcacc

SEQ ID NO: 8344 - DNA, 21 bp, Homo Sapiens
  primer_bind 1..21: downstream amplification primer 99-14882 for SEQ 479, in complement
ctcaaagccccataatgcctc

SEQ ID NO: 8345 - DNA, 21 bp, Homo Sapiens
  primer_bind 1..21: downstream amplification primer 99-14883 for SEQ 480, in complement
agcagagaatgcctgaaggac

SEQ ID NO: 8346 - DNA, 18 bp, Homo Sapiens
  primer_bind 1..18: downstream amplification primer 99-1489 for SEQ 481, in complement
tcacacagacatctgcac

SEQ ID NO: 8347 - DNA, 21 bp, Homo Sapiens
  primer_bind 1..21: downstream amplification primer 99-14890 for SEQ 482, in complement
ctcccactaagaattaagaac

SEQ ID NO: 8348 - DNA, 21 bp, Homo Sapiens
  primer_bind 1..21: downstream amplification primer 99-14892 for SEQ 483, in complement
ttttagcctttttagtgtgtg

SEQ ID NO: 8349 - DNA, 21 bp, Homo Sapiens
  primer_bind 1..21: downstream amplification primer 99-14894 for SEQ 484, in complement
ctaaatctcttctaccctctc

SEQ ID NO: 8350 - DNA, 18 bp, Homo Sapiens
  primer_bind 1..18: downstream amplification primer 99-14895 for SEQ 485, in complement
acggaggttgtctctttg

SEQ ID NO: 8351 - DNA, 21 bp, Homo Sapiens
  primer_bind 1..21: downstream amplification primer 99-14897 for SEQ 486, in complement
tttccaagttgctcgcattcc

SEQ ID NO: 8352 - DNA, 19 bp, Homo Sapiens
  primer_bind 1..19: downstream amplification primer 99-1490 for SEQ 487, in complement
gaaaacaatcaagctctgg

SEQ ID NO: 8353 - DNA, 18 bp, Homo Sapiens
  primer_bind 1..18: downstream amplification primer 99-14907 for SEQ 488, in complement
ctcccttttcctccattc

SEQ ID NO: 8354 - DNA, 19 bp, Homo Sapiens
  primer_bind 1..19: downstream amplification primer 99-1493 for SEQ 489, in complement
cctttatatccttggagtc

SEQ ID NO: 8355 - DNA, 18 bp, Homo Sapiens
  primer_bind 1..18: downstream amplification primer 99-14937 for SEQ 490, in complement
agaaccccatcatggaac

SEQ ID NO: 8356 - DNA, 21 bp, Homo Sapiens
  primer_bind 1..21: downstream amplification primer 99-14939 for SEQ 491, in complement
aagaaggctgaggaaggagtg

SEQ ID NO: 8357 - DNA, 21 bp, Homo Sapiens
  primer_bind 1..21: downstream amplification primer 99-1494 for SEQ 492, in complement
gctcaccttgcacagctatac

SEQ ID NO: 8358 - DNA, 21 bp, Homo Sapiens
  primer_bind 1..21: downstream amplification primer 99-14940 for SEQ 493, in complement
gtcgtgccaagttttaaagtg

SEQ ID NO: 8359 - DNA, 20 bp, Homo Sapiens
  primer_bind 1..20: downstream amplification primer 99-14950 for SEQ 494, in complement
cctaataccatgaatctgac

SEQ ID NO: 8360 - DNA, 19 bp, Homo Sapiens
  primer_bind 1..19: downstream amplification primer 99-14959 for SEQ 495, in complement
atccatttctctgctgctc

SEQ ID NO: 8361 - DNA, 21 bp, Homo Sapiens
  primer_bind 1..21: downstream amplification primer 99-14961 for SEQ 496, in complement
catgatttccagattgcacag

SEQ ID NO: 8362 - DNA, 19 bp, Homo Sapiens
  primer_bind 1..19: downstream amplification primer 99-14962 for SEQ 497, in complement
gagaaattgccaagctgtc

SEQ ID NO: 8363 - DNA, 20 bp, Homo Sapiens
  primer_bind 1..20: downstream amplification primer 99-14966 for SEQ 498, in complement
atgtttacagaaaacgcaac

SEQ ID NO: 8364 - DNA, 19 bp, Homo Sapiens
  primer_bind 1..19: downstream amplification primer 99-14970 for SEQ 499, in complement
gatttggaaattaagggag

SEQ ID NO: 8365 - DNA, 21 bp, Homo Sapiens
  primer_bind 1..21: downstream amplification primer 99-14978 for SEQ 500, in complement
tattactctccaaggctttgc

SEQ ID NO: 8366 - DNA, 19 bp, Homo Sapiens
  primer_bind 1..19: downstream amplification primer 99-1498 for SEQ 501, in complement
ctatcagttgggtggcttg

SEQ ID NO: 8367 - DNA, 21 bp, Homo Sapiens
  primer_bind 1..21: downstream amplification primer 99-14983 for SEQ 502, in complement
aaagaagaggttagtgtagag

SEQ ID NO: 8368 - DNA, 19 bp, Homo Sapiens
  primer_bind 1..19: downstream amplification primer 99-14984 for SEQ 503, in complement
actgctgtgaagaaaattg

SEQ ID NO: 8369 - DNA, 20 bp, Homo Sapiens
  primer_bind 1..20: downstream amplification primer 99-15005 for SEQ 504, in complement
ccctaccttgtatttctttg

SEQ ID NO: 8370 - DNA, 21 bp, Homo Sapiens
  primer_bind 1..21: downstream amplification primer 99-15007 for SEQ 505, in complement
tcaacacgaatatagggcaag

SEQ ID NO: 8371 - DNA, 20 bp, Homo Sapiens
  primer_bind 1..20: downstream amplification primer 99-1501 for SEQ 506, in complement
gtgatagttcttttttgctg

SEQ ID NO: 8372 - DNA, 20 bp, Homo Sapiens
  primer_bind 1..20: downstream amplification primer 99-15016 for SEQ 507, in complement
caattcataaaatccatgcc

SEQ ID NO: 8373 - DNA, 21 bp, Homo Sapiens
  primer_bind 1..21: downstream amplification primer 99-15018 for SEQ 508, in complement
tatttccttgttgatcttctg

SEQ ID NO: 8374 - DNA, 18 bp, Homo Sapiens
  primer_bind 1..18: downstream amplification primer 99-15019 for SEQ 509, in complement
ttgggtgatacattccag

SEQ ID NO: 8375 - DNA, 20 bp, Homo Sapiens
  primer_bind 1..20: downstream amplification primer 99-15021 for SEQ 510, in complement
gagtggaagagatgtggaac

SEQ ID NO: 8376 - DNA, 21 bp, Homo Sapiens
  primer_bind 1..21: downstream amplification primer 99-15030 for SEQ 511, in complement
cacacaacctttttcttcttc

SEQ ID NO: 8377 - DNA, 21 bp, Homo Sapiens
  primer_bind 1..21: downstream amplification primer 99-15039 for SEQ 512, in complement
attgttcctccctttcccatc

SEQ ID NO: 8378 - DNA, 21 bp, Homo Sapiens
  primer_bind 1..21: downstream amplification primer 99-1504 for SEQ 513, in complement
tccccaatatcttaaattctc

SEQ ID NO: 8379 - DNA, 19 bp, Homo Sapiens
  primer_bind 1..19: downstream amplification primer 99-15043 for SEQ 514, in complement
agggaaggaaggaaggaag

SEQ ID NO: 8380 - DNA, 18 bp, Homo Sapiens
  primer_bind 1..18: downstream amplification primer 99-15046 for SEQ 515, in complement
aaaatgcacaagcagcag

SEQ ID NO: 8381 - DNA, 21 bp, Homo Sapiens
  primer_bind 1..21: downstream amplification primer 99-1506 for SEQ 516, in complement
cctcctatttgaactctaacc

SEQ ID NO: 8382 - DNA, 20 bp, Homo Sapiens
  primer_bind 1..20: downstream amplification primer 99-15072 for SEQ 517, in complement
aggatagagaacgaaatgag

SEQ ID NO: 8383 - DNA, 21 bp, Homo Sapiens
  primer_bind 1..21: downstream amplification primer 99-15087 for SEQ 518, in complement
gcagaccatattaaagtgtag

SEQ ID NO: 8384 - DNA, 20 bp, Homo Sapiens
  primer_bind 1..20: downstream amplification primer 99-15098 for SEQ 519, in complement
tcttcctgaagtacggtggc

SEQ ID NO: 8385 - DNA, 21 bp, Homo Sapiens
  primer_bind 1..21: downstream amplification primer 99-151 for SEQ 520, in complement
tattacacgttccaactcttc

SEQ ID NO: 8386 - DNA, 18 bp, Homo Sapiens
  primer_bind 1..18: downstream amplification primer 99-15100 for SEQ 521, in complement
ctttaggagtcggctttc

SEQ ID NO: 8387 - DNA, 21 bp, Homo Sapiens
  primer_bind 1..21: downstream amplification primer 99-15101 for SEQ 522, in complement
cttcaatcatctacttctccc

SEQ ID NO: 8388 - DNA, 21 bp, Homo Sapiens
  primer_bind 1..21: downstream amplification primer 99-15106 for SEQ 523, in complement
aacacagcaagctaccatctc

SEQ ID NO: 8389 - DNA, 21 bp, Homo Sapiens
  primer_bind 1..21: downstream amplification primer 99-15107 for SEQ 524, in complement
ggtgggtgttaatgtgttggg

SEQ ID NO: 8390 - DNA, 21 bp, Homo Sapiens
  primer_bind 1..21: downstream amplification primer 99-15112 for SEQ 525, in complement
cttcttgcactcacatcctcc

SEQ ID NO: 8391 - DNA, 21 bp, Homo Sapiens
  primer_bind 1..21: downstream amplification primer 99-15118 for SEQ 526, in complement
ggctcaggcactaactctaac

SEQ ID NO: 8392 - DNA, 21 bp, Homo Sapiens
  primer_bind 1..21: downstream amplification primer 99-15123 for SEQ 527, in complement
tgccaagcactgagcaaatag

SEQ ID NO: 8393 - DNA, 21 bp, Homo Sapiens
  primer_bind 1..21: downstream amplification primer 99-15128 for SEQ 528, in complement
agaataccccttcaacatgac

SEQ ID NO: 8394 - DNA, 21 bp, Homo Sapiens
  primer_bind 1..21: downstream amplification primer 99-15129 for SEQ 529, in complement
ggtatgttctttattttgcag

SEQ ID NO: 8395 - DNA, 20 bp, Homo Sapiens
  primer_bind 1..20: downstream amplification primer 99-15135 for SEQ 530, in complement
gaataggcaagatatgaagg

SEQ ID NO: 8396 - DNA, 21 bp, Homo Sapiens
  primer_bind 1..21: downstream amplification primer 99-15137 for SEQ 531, in complement
aaaactgtattctgattctgg

SEQ ID NO: 8397 - DNA, 21 bp, Homo Sapiens
  primer_bind 1..21: downstream amplification primer 99-1515 for SEQ 532, in complement
atatgagcaccaaaggtggag

SEQ ID NO: 8398 - DNA, 21 bp, Homo Sapiens
  primer_bind 1..21: downstream amplification primer 99-15160 for SEQ 533, in complement
cctactctgattcacttgtcc

SEQ ID NO: 8399 - DNA, 19 bp, Homo Sapiens
  primer_bind 1..19: downstream amplification primer 99-15164 for SEQ 534, in complement
tttttcgaggtttgagttg

SEQ ID NO: 8400 - DNA, 19 bp, Homo Sapiens
  primer_bind 1..19: downstream amplification primer 99-15193 for SEQ 535, in complement
ctctgggctcttatttaac

SEQ ID NO: 8401 - DNA, 19 bp, Homo Sapiens
  primer_bind 1..19: downstream amplification primer 99-15195 for SEQ 536, in complement
aaactcttctaccacattc

SEQ ID NO: 8402 - DNA, 21 bp, Homo Sapiens
  primer_bind 1..21: downstream amplification primer 99-15199 for SEQ 537, in complement
ggagagttaaattgagaaaag

SEQ ID NO: 8403 - DNA, 18 bp, Homo Sapiens
  primer_bind 1..18: downstream amplification primer 99-1520 for SEQ 538, in complement
atggggaagtattggttg

SEQ ID NO: 8404 - DNA, 19 bp, Homo Sapiens
  primer_bind 1..19: downstream amplification primer 99-15200 for SEQ 539, in complement
ggagcagtgttaaatgtgg

SEQ ID NO: 8405 - DNA, 20 bp, Homo Sapiens
  primer_bind 1..20: downstream amplification primer 99-15202 for SEQ 540, in complement
ggttgttaggtaatgttagg

SEQ ID NO: 8406 - DNA, 21 bp, Homo Sapiens
  primer_bind 1..21: downstream amplification primer 99-1521 for SEQ 541, in complement
gataataagatgaagggaagg

SEQ ID NO: 8407 - DNA, 21 bp, Homo Sapiens
  primer_bind 1..21: downstream amplification primer 99-1525 for SEQ 542, in complement
ccataaatacagtttaagacc

SEQ ID NO: 8408 - DNA, 20 bp, Homo Sapiens
  primer_bind 1..20: downstream amplification primer 99-15290 for SEQ 543, in complement
ttagccccaatagtccccag

SEQ ID NO: 8409 - DNA, 20 bp, Homo Sapiens
  primer_bind 1..20: downstream amplification primer 99-15296 for SEQ 544, in complement
gttctctgctttcaaattgc

SEQ ID NO: 8410 - DNA, 19 bp, Homo Sapiens
  primer_bind 1..19: downstream amplification primer 99-15302 for SEQ 545, in complement
ctcttgggtctttcatttg

SEQ ID NO: 8411 - DNA, 20 bp, Homo Sapiens
  primer_bind 1..20: downstream amplification primer 99-15307 for SEQ 546, in complement
gctagttcagagcttcagac

SEQ ID NO: 8412 - DNA, 18 bp, Homo Sapiens
  primer_bind 1..18: downstream amplification primer 99-15310 for SEQ 547, in complement
atgatgaagcggaaagac

SEQ ID NO: 8413 - DNA, 21 bp, Homo Sapiens
  primer_bind 1..21: downstream amplification primer 99-15325 for SEQ 548, in complement
gtttgtagataaatgggattg

SEQ ID NO: 8414 - DNA, 20 bp, Homo Sapiens
  primer_bind 1..20: downstream amplification primer 99-15328 for SEQ 549, in complement
tctactctcaccacgatgcc

SEQ ID NO: 8415 - DNA, 20 bp, Homo Sapiens
  primer_bind 1..20: downstream amplification primer 99-1533 for SEQ 550, in complement
attctcaccttagaccttac

SEQ ID NO: 8416 - DNA, 21 bp, Homo Sapiens
  primer_bind 1..21: downstream amplification primer 99-15330 for SEQ 551, in complement
cctcgatttaacaaaattcac

SEQ ID NO: 8417 - DNA, 21 bp, Homo Sapiens
  primer_bind 1..21: downstream amplification primer 99-15335 for SEQ 552, in complement
ttggggttttgttgttgatgg

SEQ ID NO: 8418 - DNA, 21 bp, Homo Sapiens
  primer_bind 1..21: downstream amplification primer 99-15339 for SEQ 553, in complement
actcaccttattagaatgccc

SEQ ID NO: 8419 - DNA, 20 bp, Homo Sapiens
  primer_bind 1..20: downstream amplification primer 99-15345 for SEQ 554, in complement
tcgagcacgaaggtctgttg

SEQ ID NO: 8420 - DNA, 21 bp, Homo Sapiens
  primer_bind 1..21: downstream amplification primer 99-1535 for SEQ 555, in complement
ttaggaaagtaatggggatag

SEQ ID NO: 8421 - DNA, 18 bp, Homo Sapiens
  primer_bind 1..18: downstream amplification primer 99-1537 for SEQ 556, in complement
tgagtcaacagagagttc

SEQ ID NO: 8422 - DNA, 21 bp, Homo Sapiens
  primer_bind 1..21: downstream amplification primer 99-15374 for SEQ 557, in complement
tgaagaaaccttgaattagac

SEQ ID NO: 8423 - DNA, 19 bp, Homo Sapiens
  primer_bind 1..19: downstream amplification primer 99-15377 for SEQ 558, in complement
tttcttcttgatttgcctg

SEQ ID NO: 8424 - DNA, 21 bp, Homo Sapiens
  primer_bind 1..21: downstream amplification primer 99-15382 for SEQ 559, in complement
agatgtttataataggtgcag

SEQ ID NO: 8425 - DNA, 19 bp, Homo Sapiens
  primer_bind 1..19: downstream amplification primer 99-15393 for SEQ 560, in complement
tcctatatgagcctgagcc

SEQ ID NO: 8426 - DNA, 20 bp, Homo Sapiens
  primer_bind 1..20: downstream amplification primer 99-15406 for SEQ 561, in complement
caggaaatgcaaaaacatgg

SEQ ID NO: 8427 - DNA, 21 bp, Homo Sapiens
  primer_bind 1..21: downstream amplification primer 99-15425 for SEQ 562, in complement
gttttacaaagcaatgacaag

SEQ ID NO: 8428 - DNA, 19 bp, Homo Sapiens
  primer_bind 1..19: downstream amplification primer 99-15441 for SEQ 563, in complement
tgcaatgtttaactggttg

SEQ ID NO: 8429 - DNA, 18 bp, Homo Sapiens
  primer_bind 1..18: downstream amplification primer 99-15446 for SEQ 564, in complement
atagttcttcacacaccc

SEQ ID NO: 8430 - DNA, 20 bp, Homo Sapiens
  primer_bind 1..20: downstream amplification primer 99-15457 for SEQ 565, in complement
tgaaaatcaatatggggtag

SEQ ID NO: 8431 - DNA, 18 bp, Homo Sapiens
  primer_bind 1..18: downstream amplification primer 99-15458 for SEQ 566, in complement
ggtctttgagaaaacagg

SEQ ID NO: 8432 - DNA, 21 bp, Homo Sapiens
  primer_bind 1..21: downstream amplification primer 99-15473 for SEQ 567, in complement
ttaagtgggttgaggagaaag

SEQ ID NO: 8433 - DNA, 21 bp, Homo Sapiens
  primer_bind 1..21: downstream amplification primer 99-15486 for SEQ 568, in complement
accttacacttccaactcacc

SEQ ID NO: 8434 - DNA, 19 bp, Homo Sapiens
  primer_bind 1..19: downstream amplification primer 99-15489 for SEQ 569, in complement
actgccagaccacagtatg

SEQ ID NO: 8435 - DNA, 21 bp, Homo Sapiens
  primer_bind 1..21: downstream amplification primer 99-1549 for SEQ 570, in complement
aaaaaacactaggctctgaac

SEQ ID NO: 8436 - DNA, 18 bp, Homo Sapiens
  primer_bind 1..18: downstream amplification primer 99-15490 for SEQ 571, in complement
aagagagagaggtgatag

SEQ ID NO: 8437 - DNA, 20 bp, Homo Sapiens
  primer_bind 1..20: downstream amplification primer 99-15493 for SEQ 572, in complement
gtgtagaaaaacctaagaac

SEQ ID NO: 8438 - DNA, 19 bp, Homo Sapiens
  primer_bind 1..19: downstream amplification primer 99-15500 for SEQ 573, in complement
actatgcccacagaaaccc

SEQ ID NO: 8439 - DNA, 18 bp, Homo Sapiens
  primer_bind 1..18: downstream amplification primer 99-15502 for SEQ 574, in complement
aataggatgtggtaggtg

SEQ ID NO: 8440 - DNA, 21 bp, Homo Sapiens
  primer_bind 1..21: downstream amplification primer 99-15503 for SEQ 575, in complement
gcttaaaatcaacccaaaatc

SEQ ID NO: 8441 - DNA, 20 bp, Homo Sapiens
  primer_bind 1..20: downstream amplification primer 99-15507 for SEQ 576, in complement
tcttaccctgtgctgcttgc

SEQ ID NO: 8442 - DNA, 20 bp, Homo Sapiens
  primer_bind 1..20: downstream amplification primer 99-15508 for SEQ 577, in complement
cggttttatttgggtgtaag

SEQ ID NO: 8443 - DNA, 21 bp, Homo Sapiens
  primer_bind 1..21: downstream amplification primer 99-15511 for SEQ 578, in complement
ttaaatctttcctctcttccc

SEQ ID NO: 8444 - DNA, 21 bp, Homo Sapiens
  primer_bind 1..21: downstream amplification primer 99-15516 for SEQ 579, in complement
agtgggtttagttttacttag

SEQ ID NO: 8445 - DNA, 19 bp, Homo Sapiens
  primer_bind 1..19: downstream amplification primer 99-15524 for SEQ 580, in complement
ctaagtgcaataggaatgg

SEQ ID NO: 8446 - DNA, 18 bp, Homo Sapiens
  primer_bind 1..18: downstream amplification primer 99-15526 for SEQ 581, in complement
aagtatgctgaactggtc

SEQ ID NO: 8447 - DNA, 19 bp, Homo Sapiens
  primer_bind 1..19: downstream amplification primer 99-15527 for SEQ 582, in complement
gttcgttctgaagtaactg

SEQ ID NO: 8448 - DNA, 19 bp, Homo Sapiens
  primer_bind 1..19: downstream amplification primer 99-15528 for SEQ 583, in complement
atatgaagcaaggaaagag

SEQ ID NO: 8449 - DNA, 20 bp, Homo Sapiens
  primer_bind 1..20: downstream amplification primer 99-1553 for SEQ 584, in complement
acacaggtaagtgatacagg

SEQ ID NO: 8450 - DNA, 20 bp, Homo Sapiens
  primer_bind 1..20: downstream amplification primer 99-15543 for SEQ 585, in complement
cattttcattacttcaggtc

SEQ ID NO: 8451 - DNA, 21 bp, Homo Sapiens
  primer_bind 1..21: downstream amplification primer 99-15545 for SEQ 586, in complement
caggtcgtaaatgaatgacag

SEQ ID NO: 8452 - DNA, 19 bp, Homo Sapiens
  primer_bind 1..19: downstream amplification primer 99-15557 for SEQ 587, in complement
tttggaacacctgaaaaac

SEQ ID NO: 8453 - DNA, 19 bp, Homo Sapiens
  primer_bind 1..19: downstream amplification primer 99-1557 for SEQ 588, in complement
cacagactccaaaagaatg

SEQ ID NO: 8454 - DNA, 18 bp, Homo Sapiens
  primer_bind 1..18: downstream amplification primer 99-15574 for SEQ 589, in complement
tcttcctacctagcttac

SEQ ID NO: 8455 - DNA, 21 bp, Homo Sapiens
  primer_bind 1..21: downstream amplification primer 99-15575 for SEQ 590, in complement
gtcaatgttcattgtgtttac

SEQ ID NO: 8456 - DNA, 21 bp, Homo Sapiens
  primer_bind 1..21: downstream amplification primer 99-1558 for SEQ 591, in complement
aagcaagggataccttctggg

SEQ ID NO: 8457 - DNA, 21 bp, Homo Sapiens
  primer_bind 1..21: downstream amplification primer 99-15595 for SEQ 592, in complement
gtagcatctacccacgtattg

SEQ ID NO: 8458 - DNA, 19 bp, Homo Sapiens
  primer_bind 1..19: downstream amplification primer 99-15596 for SEQ 593, in complement
ttagcagaagacccgttcc

SEQ ID NO: 8459 - DNA, 18 bp, Homo Sapiens
  primer_bind 1..18: downstream amplification primer 99-15599 for SEQ 594, in complement
ctactgctactactctcc

SEQ ID NO: 8460 - DNA, 18 bp, Homo Sapiens
  primer_bind 1..18: downstream amplification primer 99-15605 for SEQ 595, in complement
ttccctctacattgcctc

SEQ ID NO: 8461 - DNA, 18 bp, Homo Sapiens
  primer_bind 1..18: downstream amplification primer 99-15606 for SEQ 596, in complement
tactccaatgcacttgac

SEQ ID NO: 8462 - DNA, 18 bp, Homo Sapiens
  primer_bind 1..18: downstream amplification primer 99-15625 for SEQ 597, in complement
atgggataggtgtatctc

SEQ ID NO: 8463 - DNA, 18 bp, Homo Sapiens
  primer_bind 1..18: downstream amplification primer 99-15627 for SEQ 598, in complement
aaggcagatgttaagcac

SEQ ID NO: 8464 - DNA, 21 bp, Homo Sapiens
  primer_bind 1..21: downstream amplification primer 99-15636 for SEQ 599, in complement
gaaaaggtcccaaatatgtcc

SEQ ID NO: 8465 - DNA, 21 bp, Homo Sapiens
  primer_bind 1..21: downstream amplification primer 99-15638 for SEQ 600, in complement
acacttcatagggaatcatgg

SEQ ID NO: 8466 - DNA, 21 bp, Homo Sapiens
  primer_bind 1..21: downstream amplification primer 99-15648 for SEQ 601, in complement
aacctaagaccatttgccttg

SEQ ID NO: 8467 - DNA, 20 bp, Homo Sapiens
  primer_bind 1..20: downstream amplification primer 99-15659 for SEQ 602, in complement
gagtcataaaactattctgg

SEQ ID NO: 8468 - DNA, 18 bp, Homo Sapiens
  primer_bind 1..18: downstream amplification primer 99-1568 for SEQ 603, in complement
cactccacctgtttttag

SEQ ID NO: 8469 - DNA, 20 bp, Homo Sapiens
  primer_bind 1..20: downstream amplification primer 99-15705 for SEQ 604, in complement
gcacgagcagtgatacgatg

SEQ ID NO: 8470 - DNA, 19 bp, Homo Sapiens
  primer_bind 1..19: downstream amplification primer 99-15717 for SEQ 605, in complement
tctccattttcattactcc

SEQ ID NO: 8471 - DNA, 18 bp, Homo Sapiens
  primer_bind 1..18: downstream amplification primer 99-15718 for SEQ 606, in complement
tatgtttgctgtgcatcc

SEQ ID NO: 8472 - DNA, 21 bp, Homo Sapiens
  primer_bind 1..21: downstream amplification primer 99-1572 for SEQ 607, in complement
gattattgataaagtcaggag

SEQ ID NO: 8473 - DNA, 21 bp, Homo Sapiens
  primer_bind 1..21: downstream amplification primer 99-15728 for SEQ 608, in complement
ctttgactaaatttgatggtg

SEQ ID NO: 8474 - DNA, 21 bp, Homo Sapiens
  primer_bind 1..21: downstream amplification primer 99-15739 for SEQ 609, in complement
attggtagtaatgactaggtg

SEQ ID NO: 8475 - DNA, 20 bp, Homo Sapiens
  primer_bind 1..20: downstream amplification primer 99-15744 for SEQ 610, in complement
tgtagaaaagtatcttcagc

SEQ ID NO: 8476 - DNA, 19 bp, Homo Sapiens
  primer_bind 1..19: downstream amplification primer 99-15747 for SEQ 611, in complement
gtattagcttgagattctg

SEQ ID NO: 8477 - DNA, 21 bp, Homo Sapiens
  primer_bind 1..21: downstream amplification primer 99-15748 for SEQ 612, in complement
ataagtgggaaagagaagtgg

SEQ ID NO: 8478 - DNA, 21 bp, Homo Sapiens
  primer_bind 1..21: downstream amplification primer 99-15756 for SEQ 613, in complement
gttggctgaaatgttaaactg

SEQ ID NO: 8479 - DNA, 21 bp, Homo Sapiens
  primer_bind 1..21: downstream amplification primer 99-15758 for SEQ 614, in complement
gtaatttctcacccttgttcc

SEQ ID NO: 8480 - DNA, 20 bp, Homo Sapiens
  primer_bind 1..20: downstream amplification primer 99-15762 for SEQ 615, in complement
gtcaagcgttgtttttaacc

SEQ ID NO: 8481 - DNA, 19 bp, Homo Sapiens
  primer_bind 1..19: downstream amplification primer 99-1577 for SEQ 616, in complement
actaatgggctgtgagctg

SEQ ID NO: 8482 - DNA, 18 bp, Homo Sapiens
  primer_bind 1..18: downstream amplification primer 99-15774 for SEQ 617, in complement
acttgagggtctatggtg

SEQ ID NO: 8483 - DNA, 21 bp, Homo Sapiens
  primer_bind 1..21: downstream amplification primer 99-15776 for SEQ 618, in complement
tactgtgctacatggcattgg

SEQ ID NO: 8484 - DNA, 19 bp, Homo Sapiens
  primer_bind 1..19: downstream amplification primer 99-1578 for SEQ 619, in complement
aggagaggcaacaaagcag

SEQ ID NO: 8485 - DNA, 20 bp, Homo Sapiens
  primer_bind 1..20: downstream amplification primer 99-15798 for SEQ 620, in complement
aacaacgggcaggtaagtgg

SEQ ID NO: 8486 - DNA, 21 bp, Homo Sapiens
  primer_bind 1..21: downstream amplification primer 99-15803 for SEQ 621, in complement
acttgggtatgatgtaagatg

SEQ ID NO: 8487 - DNA, 20 bp, Homo Sapiens
  primer_bind 1..20: downstream amplification primer 99-15805 for SEQ 622, in complement
tagcaaattctatgaggaac

SEQ ID NO: 8488 - DNA, 19 bp, Homo Sapiens
  primer_bind 1..19: downstream amplification primer 99-1582 for SEQ 623, in complement
cagagtttaattgagcaag

SEQ ID NO: 8489 - DNA, 18 bp, Homo Sapiens
  primer_bind 1..18: downstream amplification primer 99-15826 for SEQ 624, in complement
gacatagtaagagaagcc

SEQ ID NO: 8490 - DNA, 21 bp, Homo Sapiens
  primer_bind 1..21: downstream amplification primer 99-15830 for SEQ 625, in complement
agatgtcacttaactgtcacc

SEQ ID NO: 8491 - DNA, 20 bp, Homo Sapiens
  primer_bind 1..20: downstream amplification primer 99-1585 for SEQ 626, in complement
ttctgagataggagaaaaac

SEQ ID NO: 8492 - DNA, 20 bp, Homo Sapiens
  primer_bind 1..20: downstream amplification primer 99-1587 for SEQ 627, in complement
tggtcctgggctggttttag

SEQ ID NO: 8493 - DNA, 20 bp, Homo Sapiens
  primer_bind 1..20: downstream amplification primer 99-15891 for SEQ 628, in complement
gccactatgttctcataaag

SEQ ID NO: 8494 - DNA, 21 bp, Homo Sapiens
  primer_bind 1..21: downstream amplification primer 99-15910 for SEQ 629, in complement
gatttatgtgtgtgagaaaag

SEQ ID NO: 8495 - DNA, 21 bp, Homo Sapiens
  primer_bind 1..21: downstream amplification primer 99-15916 for SEQ 630, in complement
cacatccattgcatctttgtc

SEQ ID NO: 8496 - DNA, 21 bp, Homo Sapiens
  primer_bind 1..21: downstream amplification primer 99-15925 for SEQ 631, in complement
gctcagcagacattggttaag

SEQ ID NO: 8497 - DNA, 20 bp, Homo Sapiens
  primer_bind 1..20: downstream amplification primer 99-15947 for SEQ 632, in complement
agactcgtgagtgtccatcc

SEQ ID NO: 8498 - DNA, 19 bp, Homo Sapiens
  primer_bind 1..19: downstream amplification primer 99-15965 for SEQ 633, in complement
tataatccatcagcagcag

SEQ ID NO: 8499 - DNA, 20 bp, Homo Sapiens
  primer_bind 1..20: downstream amplification primer 99-15966 for SEQ 634, in complement
cacatttcctacctttttcc

SEQ ID NO: 8500 - DNA, 20 bp, Homo Sapiens
  primer_bind 1..20: downstream amplification primer 99-15968 for SEQ 635, in complement
atctgcttagtgcaaaagtc

SEQ ID NO: 8501 - DNA, 19 bp, Homo Sapiens
  primer_bind 1..19: downstream amplification primer 99-1597 for SEQ 636, in complement
gattgatgctaaagtagcc

SEQ ID NO: 8502 - DNA, 18 bp, Homo Sapiens
  primer_bind 1..18: downstream amplification primer 99-15970 for SEQ 637, in complement
cgacaaagctgagtgaac

SEQ ID NO: 8503 - DNA, 21 bp, Homo Sapiens
  primer_bind 1..21: downstream amplification primer 99-15973 for SEQ 638, in complement
ttggagagagatggaatgatg

SEQ ID NO: 8504 - DNA, 21 bp, Homo Sapiens
  primer_bind 1..21: downstream amplification primer 99-15981 for SEQ 639, in complement
gaaagcaatagataactgttg

SEQ ID NO: 8505 - DNA, 21 bp, Homo Sapiens
  primer_bind 1..21: downstream amplification primer 99-15985 for SEQ 640, in complement
aatctatttgacctgttatcc

SEQ ID NO: 8506 - DNA, 21 bp, Homo Sapiens
  primer_bind 1..21: downstream amplification primer 99-15992 for SEQ 641, in complement
cttagattggcaccagaatac

SEQ ID NO: 8507 - DNA, 19 bp, Homo Sapiens
  primer_bind 1..19: downstream amplification primer 99-15996 for SEQ 642, in complement
cctggaaagattatttctg

SEQ ID NO: 8508 - DNA, 19 bp, Homo Sapiens
  primer_bind 1..19: downstream amplification primer 99-16003 for SEQ 643, in complement
aatcccatgagtctctgcc

SEQ ID NO: 8509 - DNA, 19 bp, Homo Sapiens
  primer_bind 1..19: downstream amplification primer 99-16005 for SEQ 644, in complement
ccatccagccaaacaaatc

SEQ ID NO: 8510 - DNA, 21 bp, Homo Sapiens
  primer_bind 1..21: downstream amplification primer 99-1601 for SEQ 645, in complement
caaccgaccccttgagatttc

SEQ ID NO: 8511 - DNA, 20 bp, Homo Sapiens
  primer_bind 1..20: downstream amplification primer 99-1602 for SEQ 646, in complement
gtggtaggttaaaaaatcag

SEQ ID NO: 8512 - DNA, 21 bp, Homo Sapiens
  primer_bind 1..21: downstream amplification primer 99-16022 for SEQ 647, in complement
tagcctctcgatgcctgaatg

SEQ ID NO: 8513 - DNA, 21 bp, Homo Sapiens
  primer_bind 1..21: downstream amplification primer 99-16023 for SEQ 648, in complement
gttgtactgtttgctcatctg

SEQ ID NO: 8514 - DNA, 20 bp, Homo Sapiens
  primer_bind 1..20: downstream amplification primer 99-16030 for SEQ 649, in complement
tgtagcctctctcctccttc

SEQ ID NO: 8515 - DNA, 21 bp, Homo Sapiens
  primer_bind 1..21: downstream amplification primer 99-1605 for SEQ 650, in complement
ggaaagatgacttggaaaatg

SEQ ID NO: 8516 - DNA, 21 bp, Homo Sapiens
  primer_bind 1..21: downstream amplification primer 99-1607 for SEQ 651, in complement
aaaacaggtgaaagataaggg

SEQ ID NO: 8517 - DNA, 18 bp, Homo Sapiens
  primer_bind 1..18: downstream amplification primer 99-1611 for SEQ 652, in complement
gtaagatgtgacttgctg

SEQ ID NO: 8518 - DNA, 21 bp, Homo Sapiens
  primer_bind 1..21: downstream amplification primer 99-16121 for SEQ 653, in complement
ttgttttagtgggaggaatag

SEQ ID NO: 8519 - DNA, 21 bp, Homo Sapiens
  primer_bind 1..21: downstream amplification primer 99-16128 for SEQ 654, in complement
tcaaacaaaaaagaaggcaag

SEQ ID NO: 8520 - DNA, 19 bp, Homo Sapiens
  primer_bind 1..19: downstream amplification primer 99-16129 for SEQ 655, in complement
caaggaaactagcaaacac

SEQ ID NO: 8521 - DNA, 18 bp, Homo Sapiens
  primer_bind 1..18: downstream amplification primer 99-16139 for SEQ 656, in complement
tcttctatccttagcgtg

SEQ ID NO: 8522 - DNA, 18 bp, Homo Sapiens
  primer_bind 1..18: downstream amplification primer 99-16140 for SEQ 657, in complement
tccccagatgagaacaac

SEQ ID NO: 8523 - DNA, 18 bp, Homo Sapiens
  primer_bind 1..18: downstream amplification primer 99-1615 for SEQ 658, in complement
taacgcagtgagtatgcc

SEQ ID NO: 8524 - DNA, 21 bp, Homo Sapiens
  primer_bind 1..21: downstream amplification primer 99-16166 for SEQ 659, in complement
aaatgacagagacacacccac

SEQ ID NO: 8525 - DNA, 21 bp, Homo Sapiens
  primer_bind 1..21: downstream amplification primer 99-16167 for SEQ 660, in complement
gaaagatttgctataaagagg

SEQ ID NO: 8526 - DNA, 21 bp, Homo Sapiens
  primer_bind 1..21: downstream amplification primer 99-16188 for SEQ 661, in complement
tgctgtatgctattgtttagg

SEQ ID NO: 8527 - DNA, 20 bp, Homo Sapiens
  primer_bind 1..20: downstream amplification primer 99-16192 for SEQ 662, in complement
ctgattacgaaatgcaaaac

SEQ ID NO: 8528 - DNA, 21 bp, Homo Sapiens
  primer_bind 1..21: downstream amplification primer 99-16198 for SEQ 663, in complement
atcattattctgcttttggtc

SEQ ID NO: 8529 - DNA, 20 bp, Homo Sapiens
  primer_bind 1..20: downstream amplification primer 99-16202 for SEQ 664, in complement
gtcaataacaaaagcatccc

SEQ ID NO: 8530 - DNA, 18 bp, Homo Sapiens
  primer_bind 1..18: downstream amplification primer 99-16205 for SEQ 665, in complement
tccatgcccatttgtacc

SEQ ID NO: 8531 - DNA, 19 bp, Homo Sapiens
  primer_bind 1..19: downstream amplification primer 99-16210 for SEQ 666, in complement
gaccatttgtataacttcc

SEQ ID NO: 8532 - DNA, 20 bp, Homo Sapiens
  primer_bind 1..20: downstream amplification primer 99-1622 for SEQ 667, in complement
cttcaaaggaaaataatccg

SEQ ID NO: 8533 - DNA, 21 bp, Homo Sapiens
  primer_bind 1..21: downstream amplification primer 99-16221 for SEQ 668, in complement
aggaaggtttttactaattgg

SEQ ID NO: 8534 - DNA, 20 bp, Homo Sapiens
  primer_bind 1..20: downstream amplification primer 99-16227 for SEQ 669, in complement
gtacatcaaggtaatatagg

SEQ ID NO: 8535 - DNA, 21 bp, Homo Sapiens
  primer_bind 1..21: downstream amplification primer 99-1623 for SEQ 670, in complement
tgtgtgaatgctaccactgcc

SEQ ID NO: 8536 - DNA, 21 bp, Homo Sapiens
  primer_bind 1..21: downstream amplification primer 99-16247 for SEQ 671, in complement
attttctctctctcatttccc

SEQ ID NO: 8537 - DNA, 21 bp, Homo Sapiens
  primer_bind 1..21: downstream amplification primer 99-16254 for SEQ 672, in complement
agagctgcaatttcattttcc

SEQ ID NO: 8538 - DNA, 18 bp, Homo Sapiens
  primer_bind 1..18: downstream amplification primer 99-16260 for SEQ 673, in complement
gggtaattttaagggcag

SEQ ID NO: 8539 - DNA, 18 bp, Homo Sapiens
  primer_bind 1..18: downstream amplification primer 99-16262 for SEQ 674, in complement
gatgactgactgtcttag

SEQ ID NO: 8540 - DNA, 19 bp, Homo Sapiens
  primer_bind 1..19: downstream amplification primer 99-16265 for SEQ 675, in complement
cctagataacccctaattg

SEQ ID NO: 8541 - DNA, 21 bp, Homo Sapiens
  primer_bind 1..21: downstream amplification primer 99-16279 for SEQ 676, in complement
ttgtccagaacactttttcag

SEQ ID NO: 8542 - DNA, 18 bp, Homo Sapiens
  primer_bind 1..18: downstream amplification primer 99-16308 for SEQ 677, in complement
ctattttccccgcagttg

SEQ ID NO: 8543 - DNA, 21 bp, Homo Sapiens
  primer_bind 1..21: downstream amplification primer 99-16346 for SEQ 678, in complement
tctggtataaggtgtctggtg

SEQ ID NO: 8544 - DNA, 21 bp, Homo Sapiens
  primer_bind 1..21: downstream amplification primer 99-16366 for SEQ 679, in complement
ctacgaagaggtggaactttg

SEQ ID NO: 8545 - DNA, 21 bp, Homo Sapiens
  primer_bind 1..21: downstream amplification primer 99-1637 for SEQ 680, in complement
aatagtctgtagtgtggaagg

SEQ ID NO: 8546 - DNA, 19 bp, Homo Sapiens
  primer_bind 1..19: downstream amplification primer 99-16375 for SEQ 681, in complement
caagaagatgacaaagaac

SEQ ID NO: 8547 - DNA, 19 bp, Homo Sapiens
  primer_bind 1..19: downstream amplification primer 99-1638 for SEQ 682, in complement
cataaagaccactacttag

SEQ ID NO: 8548 - DNA, 18 bp, Homo Sapiens
  primer_bind 1..18: downstream amplification primer 99-16386 for SEQ 683, in complement
gccttgtctttctgggtg

SEQ ID NO: 8549 - DNA, 21 bp, Homo Sapiens
  primer_bind 1..21: downstream amplification primer 99-16396 for SEQ 684, in complement
taatataggacctagaagctg

SEQ ID NO: 8550 - DNA, 21 bp, Homo Sapiens
  primer_bind 1..21: downstream amplification primer 99-16399 for SEQ 685, in complement
tggatatttttcatttcaggg

SEQ ID NO: 8551 - DNA, 18 bp, Homo Sapiens
  primer_bind 1..18: downstream amplification primer 99-16403 for SEQ 686, in complement
gtttggactaatggagtg

SEQ ID NO: 8552 - DNA, 21 bp, Homo Sapiens
  primer_bind 1..21: downstream amplification primer 99-16407 for SEQ 687, in complement
gtctaatctccaaactgcctc

SEQ ID NO: 8553 - DNA, 18 bp, Homo Sapiens
  primer_bind 1..18: downstream amplification primer 99-16409 for SEQ 688, in complement
gaaacgagaagaacagac

SEQ ID NO: 8554 - DNA, 19 bp, Homo Sapiens
  primer_bind 1..19: downstream amplification primer 99-16414 for SEQ 689, in complement
caccatttgagtgaatacc

SEQ ID NO: 8555 - DNA, 18 bp, Homo Sapiens
  primer_bind 1..18: downstream amplification primer 99-16445 for SEQ 690, in complement
gaaaaaaactcagcaccc

SEQ ID NO: 8556 - DNA, 18 bp, Homo Sapiens
  primer_bind 1..18: downstream amplification primer 99-16466 for SEQ 691, in complement
cctgtttggtgctaaatg

SEQ ID NO: 8557 - DNA, 19 bp, Homo Sapiens
  primer_bind 1..19: downstream amplification primer 99-16474 for SEQ 692, in complement
ctgcttctgttttcttggg

SEQ ID NO: 8558 - DNA, 18 bp, Homo Sapiens
  primer_bind 1..18: downstream amplification primer 99-16500 for SEQ 693, in complement
cctaacatcctttctctc

SEQ ID NO: 8559 - DNA, 18 bp, Homo Sapiens
  primer_bind 1..18: downstream amplification primer 99-16505 for SEQ 694, in complement
ggaaggacagattggaag

SEQ ID NO: 8560 - DNA, 20 bp, Homo Sapiens
  primer_bind 1..20: downstream amplification primer 99-16526 for SEQ 695, in complement
gcacctccattttctatgcc

SEQ ID NO: 8561 - DNA, 18 bp, Homo Sapiens
  primer_bind 1..18: downstream amplification primer 99-16528 for SEQ 696, in complement
gtacaggttttcaaggag

SEQ ID NO: 8562 - DNA, 19 bp, Homo Sapiens
  primer_bind 1..19: downstream amplification primer 99-16531 for SEQ 697, in complement
gtgacttatttccaacctc

SEQ ID NO: 8563 - DNA, 18 bp, Homo Sapiens
  primer_bind 1..18: downstream amplification primer 99-16535 for SEQ 698, in complement
tatggaagcgttgtggtg

SEQ ID NO: 8564 - DNA, 19 bp, Homo Sapiens
  primer_bind 1..19: downstream amplification primer 99-16559 for SEQ 699, in complement
gagactgtttctaacttgg

SEQ ID NO: 8565 - DNA, 21 bp, Homo Sapiens
  primer_bind 1..21: downstream amplification primer 99-16562 for SEQ 700, in complement
taacttggaaggtcacatagg

SEQ ID NO: 8566 - DNA, 21 bp, Homo Sapiens
  primer_bind 1..21: downstream amplification primer 99-16563 for SEQ 701, in complement
cagaagtgacattagtgtgcc

SEQ ID NO: 8567 - DNA, 21 bp, Homo Sapiens
  primer_bind 1..21: downstream amplification primer 99-16564 for SEQ 702, in complement
tatcctttagatgcagaatcc

SEQ ID NO: 8568 - DNA, 20 bp, Homo Sapiens
  primer_bind 1..20: downstream amplification primer 99-16568 for SEQ 703, in complement
gaaaatatataggtgggtag

SEQ ID NO: 8569 - DNA, 18 bp, Homo Sapiens
  primer_bind 1..18: downstream amplification primer 99-16569 for SEQ 704, in complement
ctgcatgtcccttttgag

SEQ ID NO: 8570 - DNA, 18 bp, Homo Sapiens
  primer_bind 1..18: downstream amplification primer 99-1658 for SEQ 705, in complement
taagagatgaggtgatgg

SEQ ID NO: 8571 - DNA, 21 bp, Homo Sapiens
  primer_bind 1..21: downstream amplification primer 99-16611 for SEQ 706, in complement
tctgatgacgacggtttgatg

SEQ ID NO: 8572 - DNA, 20 bp, Homo Sapiens
  primer_bind 1..20: downstream amplification primer 99-1664 for SEQ 707, in complement
ctttgtatgtctctatctcc

SEQ ID NO: 8573 - DNA, 19 bp, Homo Sapiens
  primer_bind 1..19: downstream amplification primer 99-16655 for SEQ 708, in complement
ctctcttatgataaacagg

SEQ ID NO: 8574 - DNA, 18 bp, Homo Sapiens
  primer_bind 1..18: downstream amplification primer 99-16657 for SEQ 709, in complement
ccgaaaaccttctcaaac

SEQ ID NO: 8575 - DNA, 21 bp, Homo Sapiens
  primer_bind 1..21: downstream amplification primer 99-16677 for SEQ 710, in complement
aggaaagatcatttttagcag

SEQ ID NO: 8576 - DNA, 20 bp, Homo Sapiens
  primer_bind 1..20: downstream amplification primer 99-16683 for SEQ 711, in complement
aaaatgccctgatattcaac

SEQ ID NO: 8577 - DNA, 19 bp, Homo Sapiens
  primer_bind 1..19: downstream amplification primer 99-16692 for SEQ 712, in complement
cgttttcccaacattatcc

SEQ ID NO: 8578 - DNA, 20 bp, Homo Sapiens
  primer_bind 1..20: downstream amplification primer 99-16697 for SEQ 713, in complement
ccaagatttaaggaaacaag

SEQ ID NO: 8579 - DNA, 19 bp, Homo Sapiens
  primer_bind 1..19: downstream amplification primer 99-16708 for SEQ 714, in complement
cattgttgctggagtaatc

SEQ ID NO: 8580 - DNA, 21 bp, Homo Sapiens
  primer_bind 1..21: downstream amplification primer 99-16740 for SEQ 715, in complement
gggggtaagtatagattggtg

SEQ ID NO: 8581 - DNA, 20 bp, Homo Sapiens
  primer_bind 1..20: downstream amplification primer 99-16768 for SEQ 716, in complement
agtgttaagagaaaaggctg

SEQ ID NO: 8582 - DNA, 19 bp, Homo Sapiens
  primer_bind 1..19: downstream amplification primer 99-16801 for SEQ 717, in complement
ctgacactaaagtttttgc

SEQ ID NO: 8583 - DNA, 21 bp, Homo Sapiens
  primer_bind 1..21: downstream amplification primer 99-16827 for SEQ 718, in complement
gaaaccccactctgaaactcc

SEQ ID NO: 8584 - DNA, 18 bp, Homo Sapiens
  primer_bind 1..18: downstream amplification primer 99-16838 for SEQ 719, in complement
aggtggtagagtgtgatg

SEQ ID NO: 8585 - DNA, 21 bp, Homo Sapiens
  primer_bind 1..21: downstream amplification primer 99-16841 for SEQ 720, in complement
tttcacaggacttcttttggg

SEQ ID NO: 8586 - DNA, 18 bp, Homo Sapiens
  primer_bind 1..18: downstream amplification primer 99-16842 for SEQ 721, in complement
agaggcttcaggaatcac

SEQ ID NO: 8587 - DNA, 20 bp, Homo Sapiens
  primer_bind 1..20: downstream amplification primer 99-16845 for SEQ 722, in complement
gcttctgcggcttctttaac

SEQ ID NO: 8588 - DNA, 18 bp, Homo Sapiens
  primer_bind 1..18: downstream amplification primer 99-16847 for SEQ 723, in complement
tgggttagggaaattggg

SEQ ID NO: 8589 - DNA, 18 bp, Homo Sapiens
  primer_bind 1..18: downstream amplification primer 99-16855 for SEQ 724, in complement
gtaggattctcattgtgg

SEQ ID NO: 8590 - DNA, 21 bp, Homo Sapiens
  primer_bind 1..21: downstream amplification primer 99-16867 for SEQ 725, in complement
tctcctttctcagcctctgtg

SEQ ID NO: 8591 - DNA, 21 bp, Homo Sapiens
  primer_bind 1..21: downstream amplification primer 99-16873 for SEQ 726, in complement
ctgtagagtatttatgatgtg

SEQ ID NO: 8592 - DNA, 19 bp, Homo Sapiens
  primer_bind 1..19: downstream amplification primer 99-16886 for SEQ 727, in complement
tcttatcctgagacttctg

SEQ ID NO: 8593 - DNA, 18 bp, Homo Sapiens
  primer_bind 1..18: downstream amplification primer 99-16891 for SEQ 728, in complement
atggtgatggggtttaag

SEQ ID NO: 8594 - DNA, 21 bp, Homo Sapiens
  primer_bind 1..21: downstream amplification primer 99-16894 for SEQ 729, in complement
gaatgccctgataatatgttg

SEQ ID NO: 8595 - DNA, 18 bp, Homo Sapiens
  primer_bind 1..18: downstream amplification primer 99-16895 for SEQ 730, in complement
gaagcatacagataggac

SEQ ID NO: 8596 - DNA, 19 bp, Homo Sapiens
  primer_bind 1..19: downstream amplification primer 99-16903 for SEQ 731, in complement
tgtgagtgggagtgatgtg

SEQ ID NO: 8597 - DNA, 21 bp, Homo Sapiens
  primer_bind 1..21: downstream amplification primer 99-16905 for SEQ 732, in complement
gttgagtaaatacttcgagtg

SEQ ID NO: 8598 - DNA, 21 bp, Homo Sapiens
  primer_bind 1..21: downstream amplification primer 99-16906 for SEQ 733, in complement
tcttatcgtatgtgtattgtc

SEQ ID NO: 8599 - DNA, 18 bp, Homo Sapiens
  primer_bind 1..18: downstream amplification primer 99-16913 for SEQ 734, in complement
atttcctctgggtaactg

SEQ ID NO: 8600 - DNA, 19 bp, Homo Sapiens
  primer_bind 1..19: downstream amplification primer 99-16914 for SEQ 735, in complement
cttttaacctcacctttcc

SEQ ID NO: 8601 - DNA, 19 bp, Homo Sapiens
  primer_bind 1..19: downstream amplification primer 99-16929 for SEQ 736, in complement
gaatgtatattttgggagg

SEQ ID NO: 8602 - DNA, 20 bp, Homo Sapiens
  primer_bind 1..20: downstream amplification primer 99-16930 for SEQ 737, in complement
tgggttgttttgactaaatg

SEQ ID NO: 8603 - DNA, 21 bp, Homo Sapiens
  primer_bind 1..21: downstream amplification primer 99-16933 for SEQ 738, in complement
taagttgaatgaatgcacgcc

SEQ ID NO: 8604 - DNA, 20 bp, Homo Sapiens
  primer_bind 1..20: downstream amplification primer 99-16946 for SEQ 739, in complement
agagtgagttttaggatgtg

SEQ ID NO: 8605 - DNA, 20 bp, Homo Sapiens
  primer_bind 1..20: downstream amplification primer 99-16948 for SEQ 740, in complement
aaaaacagaaagatggacac

SEQ ID NO: 8606 - DNA, 21 bp, Homo Sapiens
  primer_bind 1..21: downstream amplification primer 99-16952 for SEQ 741, in complement
agtcagatggatgtgatatgg

SEQ ID NO: 8607 - DNA, 21 bp, Homo Sapiens
  primer_bind 1..21: downstream amplification primer 99-16975 for SEQ 742, in complement
taaaacaacacagaatccaag

SEQ ID NO: 8608 - DNA, 20 bp, Homo Sapiens
  primer_bind 1..20: downstream amplification primer 99-16979 for SEQ 743, in complement
gagtttaccgatgagtaaag

SEQ ID NO: 8609 - DNA, 19 bp, Homo Sapiens
  primer_bind 1..19: downstream amplification primer 99-16990 for SEQ 744, in complement
ctaaagtccacaaaaacag

SEQ ID NO: 8610 - DNA, 21 bp, Homo Sapiens
  primer_bind 1..21: downstream amplification primer 99-16994 for SEQ 745, in complement
aaatttgcccctagctttctc

SEQ ID NO: 8611 - DNA, 19 bp, Homo Sapiens
  primer_bind 1..19: downstream amplification primer 99-17001 for SEQ 746, in complement
gtccagacagacagaaaac

SEQ ID NO: 8612 - DNA, 21 bp, Homo Sapiens
  primer_bind 1..21: downstream amplification primer 99-17008 for SEQ 747, in complement
caaactggcataaagcatttc

SEQ ID NO: 8613 - DNA, 21 bp, Homo Sapiens
  primer_bind 1..21: downstream amplification primer 99-1701 for SEQ 748, in complement
cggattggttaataatttagg

SEQ ID NO: 8614 - DNA, 18 bp, Homo Sapiens
  primer_bind 1..18: downstream amplification primer 99-17013 for SEQ 749, in complement
catcacacctcataactc

SEQ ID NO: 8615 - DNA, 21 bp, Homo Sapiens
  primer_bind 1..21: downstream amplification primer 99-17016 for SEQ 750, in complement
tagaaagcaagacacagaaag

SEQ ID NO: 8616 - DNA, 21 bp, Homo Sapiens
  primer_bind 1..21: downstream amplification primer 99-17028 for SEQ 751, in complement
tcacttgctgtgtggttaagg

SEQ ID NO: 8617 - DNA, 19 bp, Homo Sapiens
  primer_bind 1..19: downstream amplification primer 99-17045 for SEQ 752, in complement
aattttcttcgggcataac

SEQ ID NO: 8618 - DNA, 21 bp, Homo Sapiens
  primer_bind 1..21: downstream amplification primer 99-17048 for SEQ 753, in complement
ggtcactactctcttctaagg

SEQ ID NO: 8619 - DNA, 20 bp, Homo Sapiens
  primer_bind 1..20: downstream amplification primer 99-17052 for SEQ 754, in complement
ctgatacattggtaaagtgg

SEQ ID NO: 8620 - DNA, 21 bp, Homo Sapiens
  primer_bind 1..21: downstream amplification primer 99-17062 for SEQ 755, in complement
ttctccatacctattttgaac

SEQ ID NO: 8621 - DNA, 21 bp, Homo Sapiens
  primer_bind 1..21: downstream amplification primer 99-17065 for SEQ 756, in complement
gtaggtgaagaaaatgtaaag

SEQ ID NO: 8622 - DNA, 21 bp, Homo Sapiens
  primer_bind 1..21: downstream amplification primer 99-17084 for SEQ 757, in complement
cccttactgtatctgtaggtg

SEQ ID NO: 8623 - DNA, 21 bp, Homo Sapiens
  primer_bind 1..21: downstream amplification primer 99-1709 for SEQ 758, in complement
ttggagtgaagtggaatgagg

SEQ ID NO: 8624 - DNA, 21 bp, Homo Sapiens
  primer_bind 1..21: downstream amplification primer 99-17094 for SEQ 759, in complement
ccctttctttcttcaaatgtc

SEQ ID NO: 8625 - DNA, 18 bp, Homo Sapiens
  primer_bind 1..18: downstream amplification primer 99-17095 for SEQ 760, in complement
gaattattgtggggacag

SEQ ID NO: 8626 - DNA, 18 bp, Homo Sapiens
  primer_bind 1..18: downstream amplification primer 99-1710 for SEQ 761, in complement
ggaaggagaaagagaaag

SEQ ID NO: 8627 - DNA, 18 bp, Homo Sapiens
  primer_bind 1..18: downstream amplification primer 99-17103 for SEQ 762, in complement
tgacagaaggtaagctgg

SEQ ID NO: 8628 - DNA, 18 bp, Homo Sapiens
  primer_bind 1..18: downstream amplification primer 99-17105 for SEQ 763, in complement
ctgctgaactacagaagg

SEQ ID NO: 8629 - DNA, 21 bp, Homo Sapiens
  primer_bind 1..21: downstream amplification primer 99-17112 for SEQ 764, in complement
tccaatgggctatttctaaac

SEQ ID NO: 8630 - DNA, 19 bp, Homo Sapiens
  primer_bind 1..19: downstream amplification primer 99-17122 for SEQ 765, in complement
gaacgataaagtctacctg

SEQ ID NO: 8631 - DNA, 21 bp, Homo Sapiens
  primer_bind 1..21: downstream amplification primer 99-17123 for SEQ 766, in complement
ctaatgggcgagatatagatg

SEQ ID NO: 8632 - DNA, 18 bp, Homo Sapiens
  primer_bind 1..18: downstream amplification primer 99-17133 for SEQ 767, in complement
catctaataaacccctgg

SEQ ID NO: 8633 - DNA, 21 bp, Homo Sapiens
  primer_bind 1..21: downstream amplification primer 99-17134 for SEQ 768, in complement
tatctcaaccattccctactc

SEQ ID NO: 8634 - DNA, 18 bp, Homo Sapiens
  primer_bind 1..18: downstream amplification primer 99-17136 for SEQ 769, in complement
tagagatggaactgcttg

SEQ ID NO: 8635 - DNA, 21 bp, Homo Sapiens
  primer_bind 1..21: downstream amplification primer 99-17154 for SEQ 770, in complement
ttggggttattgtaaagcctc

SEQ ID NO: 8636 - DNA, 18 bp, Homo Sapiens
  primer_bind 1..18: downstream amplification primer 99-17157 for SEQ 771, in complement
caccccaccaaatgatag

SEQ ID NO: 8637 - DNA, 21 bp, Homo Sapiens
  primer_bind 1..21: downstream amplification primer 99-17159 for SEQ 772, in complement
ttcagattagacggcgttcag

SEQ ID NO: 8638 - DNA, 21 bp, Homo Sapiens
  primer_bind 1..21: downstream amplification primer 99-17164 for SEQ 773, in complement
acaggaaattattccagaggc

SEQ ID NO: 8639 - DNA, 19 bp, Homo Sapiens
  primer_bind 1..19: downstream amplification primer 99-17165 for SEQ 774, in complement
agaagggaaaaatgatgac

SEQ ID NO: 8640 - DNA, 18 bp, Homo Sapiens
  primer_bind 1..18: downstream amplification primer 99-17169 for SEQ 775, in complement
gcatagactctcatgcac

SEQ ID NO: 8641 - DNA, 18 bp, Homo Sapiens
  primer_bind 1..18: downstream amplification primer 99-17176 for SEQ 776, in complement
agtatgttagggcttggg

SEQ ID NO: 8642 - DNA, 18 bp, Homo Sapiens
  primer_bind 1..18: downstream amplification primer 99-17180 for SEQ 777, in complement
ttctggggtttctctctc

SEQ ID NO: 8643 - DNA, 18 bp, Homo Sapiens
  primer_bind 1..18: downstream amplification primer 99-17204 for SEQ 778, in complement
tccttcctgtctttcatc

SEQ ID NO: 8644 - DNA, 21 bp, Homo Sapiens
  primer_bind 1..21: downstream amplification primer 99-17205 for SEQ 779, in complement
gtgggggtagctttgtaagtc

SEQ ID NO: 8645 - DNA, 19 bp, Homo Sapiens
  primer_bind 1..19: downstream amplification primer 99-17213 for SEQ 780, in complement
caagggtgtttattatctc

SEQ ID NO: 8646 - DNA, 19 bp, Homo Sapiens
  primer_bind 1..19: downstream amplification primer 99-1723 for SEQ 781, in complement
atcttgttaaagtgtctcc

SEQ ID NO: 8647 - DNA, 21 bp, Homo Sapiens
  primer_bind 1..21: downstream amplification primer 99-17253 for SEQ 782, in complement
ttgagggaagggtagagaagg

SEQ ID NO: 8648 - DNA, 21 bp, Homo Sapiens
  primer_bind 1..21: downstream amplification primer 99-17262 for SEQ 783, in complement
gttaaactcacaacactgctc

SEQ ID NO: 8649 - DNA, 18 bp, Homo Sapiens
  primer_bind 1..18: downstream amplification primer 99-17274 for SEQ 784, in complement
ctgactagagaatcagag

SEQ ID NO: 8650 - DNA, 18 bp, Homo Sapiens
  primer_bind 1..18: downstream amplification primer 99-17282 for SEQ 785, in complement
ggtgacaggatgatgaag

SEQ ID NO: 8651 - DNA, 21 bp, Homo Sapiens
  primer_bind 1..21: downstream amplification primer 99-17306 for SEQ 786, in complement
acagaatttagaagaaaccac

SEQ ID NO: 8652 - DNA, 20 bp, Homo Sapiens
  primer_bind 1..20: downstream amplification primer 99-17315 for SEQ 787, in complement
actccccttaccagctttcc

SEQ ID NO: 8653 - DNA, 21 bp, Homo Sapiens
  primer_bind 1..21: downstream amplification primer 99-17343 for SEQ 788, in complement
tacataaagaacaagagggag

SEQ ID NO: 8654 - DNA, 21 bp, Homo Sapiens
  primer_bind 1..21: downstream amplification primer 99-17347 for SEQ 789, in complement
ctgtgtgatttcgtgagagtg

SEQ ID NO: 8655 - DNA, 21 bp, Homo Sapiens
  primer_bind 1..21: downstream amplification primer 99-17351 for SEQ 790, in complement
aatggagctaaatctttgaac

SEQ ID NO: 8656 - DNA, 21 bp, Homo Sapiens
  primer_bind 1..21: downstream amplification primer 99-17352 for SEQ 791, in complement
cgatagaatagaacaaaatgg

SEQ ID NO: 8657 - DNA, 18 bp, Homo Sapiens
  primer_bind 1..18: downstream amplification primer 99-17357 for SEQ 792, in complement
ttgacgactatcacacac

SEQ ID NO: 8658 - DNA, 21 bp, Homo Sapiens
  primer_bind 1..21: downstream amplification primer 99-17363 for SEQ 793, in complement
atggtattgctaaaggaattg

SEQ ID NO: 8659 - DNA, 21 bp, Homo Sapiens
  primer_bind 1..21: downstream amplification primer 99-17365 for SEQ 794, in complement
ctgtcacatatacactttttc

SEQ ID NO: 8660 - DNA, 21 bp, Homo Sapiens
  primer_bind 1..21: downstream amplification primer 99-17375 for SEQ 795, in complement
gagacaatatagtaacctttc

SEQ ID NO: 8661 - DNA, 21 bp, Homo Sapiens
  primer_bind 1..21: downstream amplification primer 99-1738 for SEQ 796, in complement
ccagacaatgagattccagac

SEQ ID NO: 8662 - DNA, 21 bp, Homo Sapiens
  primer_bind 1..21: downstream amplification primer 99-17389 for SEQ 797, in complement
gctgattaactctttatcctg

SEQ ID NO: 8663 - DNA, 20 bp, Homo Sapiens
  primer_bind 1..20: downstream amplification primer 99-1739 for SEQ 798, in complement
ctgttccaagagaaaaatac

SEQ ID NO: 8664 - DNA, 18 bp, Homo Sapiens
  primer_bind 1..18: downstream amplification primer 99-17409 for SEQ 799, in complement
cctcctcttcacattcac

SEQ ID NO: 8665 - DNA, 18 bp, Homo Sapiens
  primer_bind 1..18: downstream amplification primer 99-17412 for SEQ 800, in complement
catctataaggaagtggg

SEQ ID NO: 8666 - DNA, 19 bp, Homo Sapiens
  primer_bind 1..19: downstream amplification primer 99-17416 for SEQ 801, in complement
ggcttcactctcaggaaac

SEQ ID NO: 8667 - DNA, 18 bp, Homo Sapiens
  primer_bind 1..18: downstream amplification primer 99-17418 for SEQ 802, in complement
caagtggctaataagctc

SEQ ID NO: 8668 - DNA, 18 bp, Homo Sapiens
  primer_bind 1..18: downstream amplification primer 99-17420 for SEQ 803, in complement
ccctttctgtgttagatg

SEQ ID NO: 8669 - DNA, 21 bp, Homo Sapiens
  primer_bind 1..21: downstream amplification primer 99-17428 for SEQ 804, in complement
agtattttgggtcctaccttg

SEQ ID NO: 8670 - DNA, 21 bp, Homo Sapiens
  primer_bind 1..21: downstream amplification primer 99-17450 for SEQ 805, in complement
tgtaaaacaaactgaaaagcc

SEQ ID NO: 8671 - DNA, 20 bp, Homo Sapiens
  primer_bind 1..20: downstream amplification primer 99-17464 for SEQ 806, in complement
ctgactgtgccaatgatgtg

SEQ ID NO: 8672 - DNA, 18 bp, Homo Sapiens
  primer_bind 1..18: downstream amplification primer 99-17476 for SEQ 807, in complement
acagcagctttcagcaac

SEQ ID NO: 8673 - DNA, 18 bp, Homo Sapiens
  primer_bind 1..18: downstream amplification primer 99-17481 for SEQ 808, in complement
tgactttggctcaaggac

SEQ ID NO: 8674 - DNA, 19 bp, Homo Sapiens
  primer_bind 1..19: downstream amplification primer 99-17483 for SEQ 809, in complement
acctcctgttaaatgtttc

SEQ ID NO: 8675 - DNA, 21 bp, Homo Sapiens
  primer_bind 1..21: downstream amplification primer 99-17490 for SEQ 810, in complement
ctttcactctccttctttcac

SEQ ID NO: 8676 - DNA, 19 bp, Homo Sapiens
  primer_bind 1..19: downstream amplification primer 99-17491 for SEQ 811, in complement
gatcatatcacaaacagcc

SEQ ID NO: 8677 - DNA, 18 bp, Homo Sapiens
  primer_bind 1..18: downstream amplification primer 99-17495 for SEQ 812, in complement
ttaagagcaacccacacg

SEQ ID NO: 8678 - DNA, 18 bp, Homo Sapiens
  primer_bind 1..18: downstream amplification primer 99-17496 for SEQ 813, in complement
gttagagtgtgtcccttg

SEQ ID NO: 8679 - DNA, 19 bp, Homo Sapiens
  primer_bind 1..19: downstream amplification primer 99-17498 for SEQ 814, in complement
aactgtgtttatgtagctc

SEQ ID NO: 8680 - DNA, 19 bp, Homo Sapiens
  primer_bind 1..19: downstream amplification primer 99-17499 for SEQ 815, in complement
aatccagcctcaacccaac

SEQ ID NO: 8681 - DNA, 18 bp, Homo Sapiens
  primer_bind 1..18: downstream amplification primer 99-17520 for SEQ 816, in complement
atgttcacgggagcattg

SEQ ID NO: 8682 - DNA, 18 bp, Homo Sapiens
  primer_bind 1..18: downstream amplification primer 99-17522 for SEQ 817, in complement
agaggaagaaggaacagg

SEQ ID NO: 8683 - DNA, 19 bp, Homo Sapiens
  primer_bind 1..19: downstream amplification primer 99-17523 for SEQ 818, in complement
ctaaagcctaagctctttc

SEQ ID NO: 8684 - DNA, 21 bp, Homo Sapiens
  primer_bind 1..21: downstream amplification primer 99-17529 for SEQ 819, in complement
gcaaaatgctaccccttcctc

SEQ ID NO: 8685 - DNA, 18 bp, Homo Sapiens
  primer_bind 1..18: downstream amplification primer 99-17557 for SEQ 820, in complement
tgtctgttccccgactgg

SEQ ID NO: 8686 - DNA, 21 bp, Homo Sapiens
  primer_bind 1..21: downstream amplification primer 99-17563 for SEQ 821, in complement
tagaatttgggttgctgagtc

SEQ ID NO: 8687 - DNA, 18 bp, Homo Sapiens
  primer_bind 1..18: downstream amplification primer 99-17588 for SEQ 822, in complement
gatggaaaaaggcaagag

SEQ ID NO: 8688 - DNA, 18 bp, Homo Sapiens
  primer_bind 1..18: downstream amplification primer 99-17610 for SEQ 823, in complement
atcagtcctgctgagtag

SEQ ID NO: 8689 - DNA, 18 bp, Homo Sapiens
  primer_bind 1..18: downstream amplification primer 99-17629 for SEQ 824, in complement
acgttggcaagaactatg

SEQ ID NO: 8690 - DNA, 20 bp, Homo Sapiens
  primer_bind 1..20: downstream amplification primer 99-1764 for SEQ 825, in complement
ctgagataagcatggcattg

SEQ ID NO: 8691 - DNA, 18 bp, Homo Sapiens
  primer_bind 1..18: downstream amplification primer 99-17647 for SEQ 826, in complement
atgtcaccctttctgctc

SEQ ID NO: 8692 - DNA, 21 bp, Homo Sapiens
  primer_bind 1..21: downstream amplification primer 99-1765 for SEQ 827, in complement
aatggacactctcttctttag

SEQ ID NO: 8693 - DNA, 21 bp, Homo Sapiens
  primer_bind 1..21: downstream amplification primer 99-17656 for SEQ 828, in complement
ataatactggatataggaggg

SEQ ID NO: 8694 - DNA, 21 bp, Homo Sapiens
  primer_bind 1..21: downstream amplification primer 99-17658 for SEQ 829, in complement
tctaaaatgtgctactggctc

SEQ ID NO: 8695 - DNA, 19 bp, Homo Sapiens
  primer_bind 1..19: downstream amplification primer 99-17662 for SEQ 830, in complement
ggacacagttgcatatttg

SEQ ID NO: 8696 - DNA, 19 bp, Homo Sapiens
  primer_bind 1..19: downstream amplification primer 99-17663 for SEQ 831, in complement
gatgttcacctatcttttc

SEQ ID NO: 8697 - DNA, 18 bp, Homo Sapiens
  primer_bind 1..18: downstream amplification primer 99-17677 for SEQ 832, in complement
aagtagtcaggggaaaac

SEQ ID NO: 8698 - DNA, 21 bp, Homo Sapiens
  primer_bind 1..21: downstream amplification primer 99-17680 for SEQ 833, in complement
tagaggatgatttgagcagag

SEQ ID NO: 8699 - DNA, 18 bp, Homo Sapiens
  primer_bind 1..18: downstream amplification primer 99-17683 for SEQ 834, in complement
ctcttcagactcagcatc

SEQ ID NO: 8700 - DNA, 21 bp, Homo Sapiens
  primer_bind 1..21: downstream amplification primer 99-17687 for SEQ 835, in complement
attcctactgatgaccaaccc

SEQ ID NO: 8701 - DNA, 19 bp, Homo Sapiens
  primer_bind 1..19: downstream amplification primer 99-17700 for SEQ 836, in complement
gcattgtagaaacagtgag

SEQ ID NO: 8702 - DNA, 21 bp, Homo Sapiens
  primer_bind 1..21: downstream amplification primer 99-17702 for SEQ 837, in complement
tcatttacatctactctaacc

SEQ ID NO: 8703 - DNA, 21 bp, Homo Sapiens
  primer_bind 1..21: downstream amplification primer 99-17718 for SEQ 838, in complement
gatgaacatggacaaatatac

SEQ ID NO: 8704 - DNA, 18 bp, Homo Sapiens
  primer_bind 1..18: downstream amplification primer 99-17720 for SEQ 839, in complement
atgaagcacgtttgcacc

SEQ ID NO: 8705 - DNA, 21 bp, Homo Sapiens
  primer_bind 1..21: downstream amplification primer 99-17728 for SEQ 840, in complement
ggagaaatatctgaagttagg

SEQ ID NO: 8706 - DNA, 19 bp, Homo Sapiens
  primer_bind 1..19: downstream amplification primer 99-1773 for SEQ 841, in complement
atagcttacaatcaactgg

SEQ ID NO: 8707 - DNA, 21 bp, Homo Sapiens
  primer_bind 1..21: downstream amplification primer 99-17740 for SEQ 842, in complement
tataatgtaagcctgagtttg

SEQ ID NO: 8708 - DNA, 21 bp, Homo Sapiens
  primer_bind 1..21: downstream amplification primer 99-1775 for SEQ 843, in complement
ctcttgaatacttctacaggg

SEQ ID NO: 8709 - DNA, 21 bp, Homo Sapiens
  primer_bind 1..21: downstream amplification primer 99-17758 for SEQ 844, in complement
ttactcttcattcttatgtgg

SEQ ID NO: 8710 - DNA, 21 bp, Homo Sapiens
  primer_bind 1..21: downstream amplification primer 99-17762 for SEQ 845, in complement
aatgtgtatagatttctggtg

SEQ ID NO: 8711 - DNA, 18 bp, Homo Sapiens
  primer_bind 1..18: downstream amplification primer 99-17773 for SEQ 846, in complement
gtagaaccaatccaccag

SEQ ID NO: 8712 - DNA, 21 bp, Homo Sapiens
  primer_bind 1..21: downstream amplification primer 99-17774 for SEQ 847, in complement
gcttagttcttccacataatc

SEQ ID NO: 8713 - DNA, 21 bp, Homo Sapiens
  primer_bind 1..21: downstream amplification primer 99-17775 for SEQ 848, in complement
gcacacacatagtaggcaaag

SEQ ID NO: 8714 - DNA, 20 bp, Homo Sapiens
  primer_bind 1..20: downstream amplification primer 99-17776 for SEQ 849, in complement
gaaccaaacacatacagaac

SEQ ID NO: 8715 - DNA, 19 bp, Homo Sapiens
  primer_bind 1..19: downstream amplification primer 99-17779 for SEQ 850, in complement
catacatgcagaatattgg

SEQ ID NO: 8716 - DNA, 18 bp, Homo Sapiens
  primer_bind 1..18: downstream amplification primer 99-17792 for SEQ 851, in complement
tgaccagcaaggtgtgac

SEQ ID NO: 8717 - DNA, 21 bp, Homo Sapiens
  primer_bind 1..21: downstream amplification primer 99-17798 for SEQ 852, in complement
ccaattcctcactctatgccc

SEQ ID NO: 8718 - DNA, 20 bp, Homo Sapiens
  primer_bind 1..20: downstream amplification primer 99-17802 for SEQ 853, in complement
gtgtttgtcacagctacacc

SEQ ID NO: 8719 - DNA, 19 bp, Homo Sapiens
  primer_bind 1..19: downstream amplification primer 99-17808 for SEQ 854, in complement
ggggggttacataaaattg

SEQ ID NO: 8720 - DNA, 21 bp, Homo Sapiens
  primer_bind 1..21: downstream amplification primer 99-1781 for SEQ 855, in complement
tcaccaccaattacaaatacc

SEQ ID NO: 8721 - DNA, 18 bp, Homo Sapiens
  primer_bind 1..18: downstream amplification primer 99-17810 for SEQ 856, in complement
aattcgctaggtgcagag

SEQ ID NO: 8722 - DNA, 21 bp, Homo Sapiens
  primer_bind 1..21: downstream amplification primer 99-17816 for SEQ 857, in complement
gcccttttcctaactatgctg

SEQ ID NO: 8723 - DNA, 20 bp, Homo Sapiens
  primer_bind 1..20: downstream amplification primer 99-17820 for SEQ 858, in complement
gtcattgagaactttgaacc

SEQ ID NO: 8724 - DNA, 21 bp, Homo Sapiens
  primer_bind 1..21: downstream amplification primer 99-17821 for SEQ 859, in complement
gggatgttgtcttaataggtg

SEQ ID NO: 8725 - DNA, 18 bp, Homo Sapiens
  primer_bind 1..18: downstream amplification primer 99-17827 for SEQ 860, in complement
cgttggtttggctttttc

SEQ ID NO: 8726 - DNA, 21 bp, Homo Sapiens
  primer_bind 1..21: downstream amplification primer 99-17829 for SEQ 861, in complement
cttttctattagagagagacc

SEQ ID NO: 8727 - DNA, 21 bp, Homo Sapiens
  primer_bind 1..21: downstream amplification primer 99-17833 for SEQ 862, in complement
tcttttcaaaatgatgtcccc

SEQ ID NO: 8728 - DNA, 19 bp, Homo Sapiens
  primer_bind 1..19: downstream amplification primer 99-17845 for SEQ 863, in complement
tagtgacaaggatgagggg

SEQ ID NO: 8729 - DNA, 20 bp, Homo Sapiens
  primer_bind 1..20: downstream amplification primer 99-17854 for SEQ 864, in complement
agacttctggtggggatagg

SEQ ID NO: 8730 - DNA, 19 bp, Homo Sapiens
  primer_bind 1..19: downstream amplification primer 99-17856 for SEQ 865, in complement
gctgatcttcagtttctac

SEQ ID NO: 8731 - DNA, 21 bp, Homo Sapiens
  primer_bind 1..21: downstream amplification primer 99-17857 for SEQ 866, in complement
aacagcccagcacaatttcac

SEQ ID NO: 8732 - DNA, 20 bp, Homo Sapiens
  primer_bind 1..20: downstream amplification primer 99-17863 for SEQ 867, in complement
gggaaaagaaagttgaagtg

SEQ ID NO: 8733 - DNA, 18 bp, Homo Sapiens
  primer_bind 1..18: downstream amplification primer 99-17864 for SEQ 868, in complement
atttgtggctcactatgg

SEQ ID NO: 8734 - DNA, 18 bp, Homo Sapiens
  primer_bind 1..18: downstream amplification primer 99-17866 for SEQ 869, in complement
tggaaggctaagtaaagg

SEQ ID NO: 8735 - DNA, 18 bp, Homo Sapiens
  primer_bind 1..18: downstream amplification primer 99-17889 for SEQ 870, in complement
cttttttctcactgcacc

SEQ ID NO: 8736 - DNA, 19 bp, Homo Sapiens
  primer_bind 1..19: downstream amplification primer 99-17890 for SEQ 871, in complement
ttacgaagcagtctttttg

SEQ ID NO: 8737 - DNA, 21 bp, Homo Sapiens
  primer_bind 1..21: downstream amplification primer 99-17899 for SEQ 872, in complement
gaaacaacatcatttgaggac

SEQ ID NO: 8738 - DNA, 18 bp, Homo Sapiens
  primer_bind 1..18: downstream amplification primer 99-17913 for SEQ 873, in complement
gcgtttccatgataatcc

SEQ ID NO: 8739 - DNA, 21 bp, Homo Sapiens
  primer_bind 1..21: downstream amplification primer 99-17920 for SEQ 874, in complement
ctttgctctcctgctaggttg

SEQ ID NO: 8740 - DNA, 18 bp, Homo Sapiens
  primer_bind 1..18: downstream amplification primer 99-1793 for SEQ 875, in complement
tgccgccatccacataag

SEQ ID NO: 8741 - DNA, 18 bp, Homo Sapiens
  primer_bind 1..18: downstream amplification primer 99-17938 for SEQ 876, in complement
gcggatcagcaagaatac

SEQ ID NO: 8742 - DNA, 21 bp, Homo Sapiens
  primer_bind 1..21: downstream amplification primer 99-17945 for SEQ 877, in complement
gtaagcatttgtccaaaattg

SEQ ID NO: 8743 - DNA, 18 bp, Homo Sapiens
  primer_bind 1..18: downstream amplification primer 99-17946 for SEQ 878, in complement
caatgaaatcacagggtc

SEQ ID NO: 8744 - DNA, 21 bp, Homo Sapiens
  primer_bind 1..21: downstream amplification primer 99-17952 for SEQ 879, in complement
tgttgaaaatctccttgtatg

SEQ ID NO: 8745 - DNA, 21 bp, Homo Sapiens
  primer_bind 1..21: downstream amplification primer 99-1796 for SEQ 880, in complement
aatgtgttaaagaccatgctg

SEQ ID NO: 8746 - DNA, 20 bp, Homo Sapiens
  primer_bind 1..20: downstream amplification primer 99-17971 for SEQ 881, in complement
acctcacaccaacatccctc

SEQ ID NO: 8747 - DNA, 19 bp, Homo Sapiens
  primer_bind 1..19: downstream amplification primer 99-17976 for SEQ 882, in complement
tggctacagagaatcccag

SEQ ID NO: 8748 - DNA, 19 bp, Homo Sapiens
  primer_bind 1..19: downstream amplification primer 99-17989 for SEQ 883, in complement
actctaggaggggaagaac

SEQ ID NO: 8749 - DNA, 21 bp, Homo Sapiens
  primer_bind 1..21: downstream amplification primer 99-17991 for SEQ 884, in complement
atcaaatctacttgcataacc

SEQ ID NO: 8750 - DNA, 18 bp, Homo Sapiens
  primer_bind 1..18: downstream amplification primer 99-17992 for SEQ 885, in complement
cctttcctatgtaacctc

SEQ ID NO: 8751 - DNA, 21 bp, Homo Sapiens
  primer_bind 1..21: downstream amplification primer 99-18004 for SEQ 886, in complement
tccttttttttacagcatctc

SEQ ID NO: 8752 - DNA, 20 bp, Homo Sapiens
  primer_bind 1..20: downstream amplification primer 99-18007 for SEQ 887, in complement
gcctaattaagatcaaactc

SEQ ID NO: 8753 - DNA, 21 bp, Homo Sapiens
  primer_bind 1..21: downstream amplification primer 99-18030 for SEQ 888, in complement
aagtgtgtgttagaaggcaag

SEQ ID NO: 8754 - DNA, 21 bp, Homo Sapiens
  primer_bind 1..21: downstream amplification primer 99-18038 for SEQ 889, in complement
agacatacagcaaagagagcc

SEQ ID NO: 8755 - DNA, 21 bp, Homo Sapiens
  primer_bind 1..21: downstream amplification primer 99-18046 for SEQ 890, in complement
ttttgatgatggtctttgaag

SEQ ID NO: 8756 - DNA, 18 bp, Homo Sapiens
  primer_bind 1..18: downstream amplification primer 99-18053 for SEQ 891, in complement
gccatcatcttgaaagac

SEQ ID NO: 8757 - DNA, 21 bp, Homo Sapiens
  primer_bind 1..21: downstream amplification primer 99-18054 for SEQ 892, in complement
ttcatcccttttaccgagtcc

SEQ ID NO: 8758 - DNA, 18 bp, Homo Sapiens
  primer_bind 1..18: downstream amplification primer 99-18056 for SEQ 893, in complement
tagagagcttctgagctg

SEQ ID NO: 8759 - DNA, 19 bp, Homo Sapiens
  primer_bind 1..19: downstream amplification primer 99-18057 for SEQ 894, in complement
ccctcttattcatacttag

SEQ ID NO: 8760 - DNA, 18 bp, Homo Sapiens
  primer_bind 1..18: downstream amplification primer 99-18060 for SEQ 895, in complement
gagtgactaatggctgtg

SEQ ID NO: 8761 - DNA, 19 bp, Homo Sapiens
  primer_bind 1..19: downstream amplification primer 99-18062 for SEQ 896, in complement
gagagtagtaatacttacc

SEQ ID NO: 8762 - DNA, 21 bp, Homo Sapiens
  primer_bind 1..21: downstream amplification primer 99-18069 for SEQ 897, in complement
caattctcaacatggtaagtc

SEQ ID NO: 8763 - DNA, 19 bp, Homo Sapiens
  primer_bind 1..19: downstream amplification primer 99-18079 for SEQ 898, in complement
ttttaagcaccagtgtatc

SEQ ID NO: 8764 - DNA, 21 bp, Homo Sapiens
  primer_bind 1..21: downstream amplification primer 99-1808 for SEQ 899, in complement
ctgaagataaaactggaaagg

SEQ ID NO: 8765 - DNA, 18 bp, Homo Sapiens
  primer_bind 1..18: downstream amplification primer 99-18080 for SEQ 900, in complement
cgtgtgtaacaaggcttc

SEQ ID NO: 8766 - DNA, 18 bp, Homo Sapiens
  primer_bind 1..18: downstream amplification primer 99-18085 for SEQ 901, in complement
ttccccttatccaatccc

SEQ ID NO: 8767 - DNA, 18 bp, Homo Sapiens
  primer_bind 1..18: downstream amplification primer 99-18086 for SEQ 902, in complement
catctggtcttattcctc

SEQ ID NO: 8768 - DNA, 19 bp, Homo Sapiens
  primer_bind 1..19: downstream amplification primer 99-18087 for SEQ 903, in complement
ctgtctttgtcttataccc

SEQ ID NO: 8769 - DNA, 21 bp, Homo Sapiens
  primer_bind 1..21: downstream amplification primer 99-18091 for SEQ 904, in complement
aacacaattcccctgcctaag

SEQ ID NO: 8770 - DNA, 18 bp, Homo Sapiens
  primer_bind 1..18: downstream amplification primer 99-18096 for SEQ 905, in complement
gacaagatttggggtaag

SEQ ID NO: 8771 - DNA, 18 bp, Homo Sapiens
  primer_bind 1..18: downstream amplification primer 99-18109 for SEQ 906, in complement
tctttgacacatcacccc

SEQ ID NO: 8772 - DNA, 20 bp, Homo Sapiens
  primer_bind 1..20: downstream amplification primer 99-1813 for SEQ 907, in complement
agtgtggtgtaaattaaagg

SEQ ID NO: 8773 - DNA, 19 bp, Homo Sapiens
  primer_bind 1..19: downstream amplification primer 99-18130 for SEQ 908, in complement
atgctgacgaggcatgaac

SEQ ID NO: 8774 - DNA, 21 bp, Homo Sapiens
  primer_bind 1..21: downstream amplification primer 99-1814 for SEQ 909, in complement
ttaaatcagtggaaaatccag

SEQ ID NO: 8775 - DNA, 19 bp, Homo Sapiens
  primer_bind 1..19: downstream amplification primer 99-18171 for SEQ 910, in complement
ttatcattcaggagaatgc

SEQ ID NO: 8776 - DNA, 21 bp, Homo Sapiens
  primer_bind 1..21: downstream amplification primer 99-18172 for SEQ 911, in complement
ggtctgtttttgttgttattg

SEQ ID NO: 8777 - DNA, 18 bp, Homo Sapiens
  primer_bind 1..18: downstream amplification primer 99-18179 for SEQ 912, in complement
tacagccctcaactacag

SEQ ID NO: 8778 - DNA, 18 bp, Homo Sapiens
  primer_bind 1..18: downstream amplification primer 99-18198 for SEQ 913, in complement
cctgtatctgttgacttg

SEQ ID NO: 8779 - DNA, 21 bp, Homo Sapiens
  primer_bind 1..21: downstream amplification primer 99-18201 for SEQ 914, in complement
ttctttttttccctctttccc

SEQ ID NO: 8780 - DNA, 19 bp, Homo Sapiens
  primer_bind 1..19: downstream amplification primer 99-18206 for SEQ 915, in complement
gatcaggaagcaaaataag

SEQ ID NO: 8781 - DNA, 21 bp, Homo Sapiens
  primer_bind 1..21: downstream amplification primer 99-18210 for SEQ 916, in complement
gaatgtactttcaaatcctcc

SEQ ID NO: 8782 - DNA, 19 bp, Homo Sapiens
  primer_bind 1..19: downstream amplification primer 99-18213 for SEQ 917, in complement
ctcataaagccaggaacac

SEQ ID NO: 8783 - DNA, 21 bp, Homo Sapiens
  primer_bind 1..21: downstream amplification primer 99-18214 for SEQ 918, in complement
gtacgtttcctctgttcaatc

SEQ ID NO: 8784 - DNA, 18 bp, Homo Sapiens
  primer_bind 1..18: downstream amplification primer 99-18221 for SEQ 919, in complement
aggcagaaaaaaaggcag

SEQ ID NO: 8785 - DNA, 21 bp, Homo Sapiens
  primer_bind 1..21: downstream amplification primer 99-1823 for SEQ 920, in complement
ctgaagaatccttaggttgtg

SEQ ID NO: 8786 - DNA, 21 bp, Homo Sapiens
  primer_bind 1..21: downstream amplification primer 99-1824 for SEQ 921, in complement
aatatttgagtccctgaagtg

SEQ ID NO: 8787 - DNA, 21 bp, Homo Sapiens
  primer_bind 1..21: downstream amplification primer 99-18242 for SEQ 922, in complement
acacttttgtaaggttcatgg

SEQ ID NO: 8788 - DNA, 18 bp, Homo Sapiens
  primer_bind 1..18: downstream amplification primer 99-18253 for SEQ 923, in complement
gttggctcagtttcactc

SEQ ID NO: 8789 - DNA, 21 bp, Homo Sapiens
  primer_bind 1..21: downstream amplification primer 99-18255 for SEQ 924, in complement
cagaaataaatgagaacaacc

SEQ ID NO: 8790 - DNA, 20 bp, Homo Sapiens
  primer_bind 1..20: downstream amplification primer 99-18258 for SEQ 925, in complement
caaagtaggtggaaaaatgg

SEQ ID NO: 8791 - DNA, 18 bp, Homo Sapiens
  primer_bind 1..18: downstream amplification primer 99-18268 for SEQ 926, in complement
caacacacagtggataag

SEQ ID NO: 8792 - DNA, 18 bp, Homo Sapiens
  primer_bind 1..18: downstream amplification primer 99-18272 for SEQ 927, in complement
cctttagggttagggttg

SEQ ID NO: 8793 - DNA, 21 bp, Homo Sapiens
  primer_bind 1..21: downstream amplification primer 99-18276 for SEQ 928, in complement
atctcattatcaaccccatcc

SEQ ID NO: 8794 - DNA, 18 bp, Homo Sapiens
  primer_bind 1..18: downstream amplification primer 99-18288 for SEQ 929, in complement
caaggagtgtgatttcag

SEQ ID NO: 8795 - DNA, 20 bp, Homo Sapiens
  primer_bind 1..20: downstream amplification primer 99-18289 for SEQ 930, in complement
gcctttgaataaactagatg

SEQ ID NO: 8796 - DNA, 21 bp, Homo Sapiens
  primer_bind 1..21: downstream amplification primer 99-18303 for SEQ 931, in complement
aagtttctgtcttgtcacgcc

SEQ ID NO: 8797 - DNA, 20 bp, Homo Sapiens
  primer_bind 1..20: downstream amplification primer 99-18306 for SEQ 932, in complement
cagacaaaccaggttattag

SEQ ID NO: 8798 - DNA, 21 bp, Homo Sapiens
  primer_bind 1..21: downstream amplification primer 99-18307 for SEQ 933, in complement
gtttagtggctggaatgcagg

SEQ ID NO: 8799 - DNA, 21 bp, Homo Sapiens
  primer_bind 1..21: downstream amplification primer 99-18310 for SEQ 934, in complement
ctgcttagtctctagttcagg

SEQ ID NO: 8800 - DNA, 19 bp, Homo Sapiens
  primer_bind 1..19: downstream amplification primer 99-18312 for SEQ 935, in complement
cattcaaaacttcccaaac

SEQ ID NO: 8801 - DNA, 19 bp, Homo Sapiens
  primer_bind 1..19: downstream amplification primer 99-18341 for SEQ 936, in complement
ttatcattcaggagaatgc

SEQ ID NO: 8802 - DNA, 21 bp, Homo Sapiens
  primer_bind 1..21: downstream amplification primer 99-18344 for SEQ 937, in complement
ggtctgtttttgttgttattg

SEQ ID NO: 8803 - DNA, 19 bp, Homo Sapiens
  primer_bind 1..19: downstream amplification primer 99-18345 for SEQ 938, in complement
acagggaaggatcactgag

SEQ ID NO: 8804 - DNA, 20 bp, Homo Sapiens
  primer_bind 1..20: downstream amplification primer 99-18371 for SEQ 939, in complement
caacttctaattgttactgg

SEQ ID NO: 8805 - DNA, 21 bp, Homo Sapiens
  primer_bind 1..21: downstream amplification primer 99-18373 for SEQ 940, in complement
gaaataaggaattaagagagg

SEQ ID NO: 8806 - DNA, 21 bp, Homo Sapiens
  primer_bind 1..21: downstream amplification primer 99-18375 for SEQ 941, in complement
ataaatcacaacaaactggac

SEQ ID NO: 8807 - DNA, 21 bp, Homo Sapiens
  primer_bind 1..21: downstream amplification primer 99-18379 for SEQ 942, in complement
tcccaaatctctcttaaacac

SEQ ID NO: 8808 - DNA, 18 bp, Homo Sapiens
  primer_bind 1..18: downstream amplification primer 99-18386 for SEQ 943, in complement
gaccttgaagagaacctg

SEQ ID NO: 8809 - DNA, 21 bp, Homo Sapiens
  primer_bind 1..21: downstream amplification primer 99-18394 for SEQ 944, in complement
aggaatatacgatagttaagg

SEQ ID NO: 8810 - DNA, 20 bp, Homo Sapiens
  primer_bind 1..20: downstream amplification primer 99-18402 for SEQ 945, in complement
catcactaattgaggatgac

SEQ ID NO: 8811 - DNA, 20 bp, Homo Sapiens
  primer_bind 1..20: downstream amplification primer 99-18406 for SEQ 946, in complement
attgctgcttctttactgtc

SEQ ID NO: 8812 - DNA, 18 bp, Homo Sapiens
  primer_bind 1..18: downstream amplification primer 99-18414 for SEQ 947, in complement
cccacactcaacctttac

SEQ ID NO: 8813 - DNA, 20 bp, Homo Sapiens
  primer_bind 1..20: downstream amplification primer 99-18418 for SEQ 948, in complement
gtaaaagatacttccctctg

SEQ ID NO: 8814 - DNA, 21 bp, Homo Sapiens
  primer_bind 1..21: downstream amplification primer 99-1842 for SEQ 949, in complement
ttggtttctttctatctgttg

SEQ ID NO: 8815 - DNA, 18 bp, Homo Sapiens
  primer_bind 1..18: downstream amplification primer 99-18423 for SEQ 950, in complement
cccgaatgaggctaattg

SEQ ID NO: 8816 - DNA, 18 bp, Homo Sapiens
  primer_bind 1..18: downstream amplification primer 99-18427 for SEQ 951, in complement
gttcctatttcctgatcc

SEQ ID NO: 8817 - DNA, 19 bp, Homo Sapiens
  primer_bind 1..19: downstream amplification primer 99-18438 for SEQ 952, in complement
aacaaacaaacaactagcc

SEQ ID NO: 8818 - DNA, 18 bp, Homo Sapiens
  primer_bind 1..18: downstream amplification primer 99-18442 for SEQ 953, in complement
tcaatgaagtcgtgtgcc

SEQ ID NO: 8819 - DNA, 21 bp, Homo Sapiens
  primer_bind 1..21: downstream amplification primer 99-18444 for SEQ 954, in complement
tttaacttatgaaggaagagg

SEQ ID NO: 8820 - DNA, 21 bp, Homo Sapiens
  primer_bind 1..21: downstream amplification primer 99-18458 for SEQ 955, in complement
cagggcttatacttgactctc

SEQ ID NO: 8821 - DNA, 18 bp, Homo Sapiens
  primer_bind 1..18: downstream amplification primer 99-18470 for SEQ 956, in complement
ggagtgtgttgctttatg

SEQ ID NO: 8822 - DNA, 20 bp, Homo Sapiens
  primer_bind 1..20: downstream amplification primer 99-18478 for SEQ 957, in complement
atatgcctcatctgtcattc

SEQ ID NO: 8823 - DNA, 21 bp, Homo Sapiens
  primer_bind 1..21: downstream amplification primer 99-18486 for SEQ 958, in complement
gtctgcgtttctcacaacacc

SEQ ID NO: 8824 - DNA, 20 bp, Homo Sapiens
  primer_bind 1..20: downstream amplification primer 99-18487 for SEQ 959, in complement
caaatatccccaaatacaac

SEQ ID NO: 8825 - DNA, 18 bp, Homo Sapiens
  primer_bind 1..18: downstream amplification primer 99-18488 for SEQ 960, in complement
accatgagcctcagatac

SEQ ID NO: 8826 - DNA, 21 bp, Homo Sapiens
  primer_bind 1..21: downstream amplification primer 99-1849 for SEQ 961, in complement
atagccacaagttcaaaaccc

SEQ ID NO: 8827 - DNA, 21 bp, Homo Sapiens
  primer_bind 1..21: downstream amplification primer 99-18536 for SEQ 962, in complement
tctatcaagttgtgttttgtc

SEQ ID NO: 8828 - DNA, 19 bp, Homo Sapiens
  primer_bind 1..19: downstream amplification primer 99-18542 for SEQ 963, in complement
tgactgttgcagctctagg

SEQ ID NO: 8829 - DNA, 18 bp, Homo Sapiens
  primer_bind 1..18: downstream amplification primer 99-18551 for SEQ 964, in complement
atctctgaaaagccgatg

SEQ ID NO: 8830 - DNA, 20 bp, Homo Sapiens
  primer_bind 1..20: downstream amplification primer 99-18561 for SEQ 965, in complement
ttttctgtcctctaggaatg

SEQ ID NO: 8831 - DNA, 20 bp, Homo Sapiens
  primer_bind 1..20: downstream amplification primer 99-18573 for SEQ 966, in complement
cttattttccatcctttgcc

SEQ ID NO: 8832 - DNA, 21 bp, Homo Sapiens
  primer_bind 1..21: downstream amplification primer 99-18582 for SEQ 967, in complement
tctaagactcatcatcaggac

SEQ ID NO: 8833 - DNA, 21 bp, Homo Sapiens
  primer_bind 1..21: downstream amplification primer 99-18588 for SEQ 968, in complement
ttttaacagtcaccctttgcc

SEQ ID NO: 8834 - DNA, 21 bp, Homo Sapiens
  primer_bind 1..21: downstream amplification primer 99-18596 for SEQ 969, in complement
aagtatagttccaaggaagag

SEQ ID NO: 8835 - DNA, 21 bp, Homo Sapiens
  primer_bind 1..21: downstream amplification primer 99-18597 for SEQ 970, in complement
gtaggatggctggattttggg

SEQ ID NO: 8836 - DNA, 21 bp, Homo Sapiens
  primer_bind 1..21: downstream amplification primer 99-18599 for SEQ 971, in complement
gatgtaagtgaagaaatactg

SEQ ID NO: 8837 - DNA, 21 bp, Homo Sapiens
  primer_bind 1..21: downstream amplification primer 99-1860 for SEQ 972, in complement
ctaattctatcctctaattcc

SEQ ID NO: 8838 - DNA, 20 bp, Homo Sapiens
  primer_bind 1..20: downstream amplification primer 99-18602 for SEQ 973, in complement
atggtgggaatggagaggag

SEQ ID NO: 8839 - DNA, 19 bp, Homo Sapiens
  primer_bind 1..19: downstream amplification primer 99-18606 for SEQ 974, in complement
gaaagtgtgtgtggaaatg

SEQ ID NO: 8840 - DNA, 21 bp, Homo Sapiens
  primer_bind 1..21: downstream amplification primer 99-1861 for SEQ 975, in complement
gtgagaaatgatagggaagac

SEQ ID NO: 8841 - DNA, 20 bp, Homo Sapiens
  primer_bind 1..20: downstream amplification primer 99-18612 for SEQ 976, in complement
gactcattcacaatttgcac

SEQ ID NO: 8842 - DNA, 21 bp, Homo Sapiens
  primer_bind 1..21: downstream amplification primer 99-18618 for SEQ 977, in complement
tttgataaatgggaaattggg

SEQ ID NO: 8843 - DNA, 21 bp, Homo Sapiens
  primer_bind 1..21: downstream amplification primer 99-18620 for SEQ 978, in complement
cagcaagacacaaatgggaag

SEQ ID NO: 8844 - DNA, 20 bp, Homo Sapiens
  primer_bind 1..20: downstream amplification primer 99-18637 for SEQ 979, in complement
caccctggtacattgctttg

SEQ ID NO: 8845 - DNA, 21 bp, Homo Sapiens
  primer_bind 1..21: downstream amplification primer 99-18638 for SEQ 980, in complement
gtattttctgggttcaatttc

SEQ ID NO: 8846 - DNA, 20 bp, Homo Sapiens
  primer_bind 1..20: downstream amplification primer 99-18640 for SEQ 981, in complement
ggcagagcagggatttaaag

SEQ ID NO: 8847 - DNA, 18 bp, Homo Sapiens
  primer_bind 1..18: downstream amplification primer 99-18648 for SEQ 982, in complement
gaagcaatttcccaagag

SEQ ID NO: 8848 - DNA, 21 bp, Homo Sapiens
  primer_bind 1..21: downstream amplification primer 99-18666 for SEQ 983, in complement
gcttctagggctttcatctac

SEQ ID NO: 8849 - DNA, 21 bp, Homo Sapiens
  primer_bind 1..21: downstream amplification primer 99-18667 for SEQ 984, in complement
tgaagtccataaaggaccaag

SEQ ID NO: 8850 - DNA, 19 bp, Homo Sapiens
  primer_bind 1..19: downstream amplification primer 99-18669 for SEQ 985, in complement
cagccacacctaaaaaaag

SEQ ID NO: 8851 - DNA, 21 bp, Homo Sapiens
  primer_bind 1..21: downstream amplification primer 99-18715 for SEQ 986, in complement
aggttggggaattttaggtgg

SEQ ID NO: 8852 - DNA, 21 bp, Homo Sapiens
  primer_bind 1..21: downstream amplification primer 99-18719 for SEQ 987, in complement
tgctaatttgacctgaatctg

SEQ ID NO: 8853 - DNA, 21 bp, Homo Sapiens
  primer_bind 1..21: downstream amplification primer 99-18720 for SEQ 988, in complement
ttggcaaggaaacagattcag

SEQ ID NO: 8854 - DNA, 19 bp, Homo Sapiens
  primer_bind 1..19: downstream amplification primer 99-18721 for SEQ 989, in complement
ccataacttgatatgagac

SEQ ID NO: 8855 - DNA, 19 bp, Homo Sapiens
  primer_bind 1..19: downstream amplification primer 99-18724 for SEQ 990, in complement
actgtcttccttgctgctc

SEQ ID NO: 8856 - DNA, 21 bp, Homo Sapiens
  primer_bind 1..21: downstream amplification primer 99-18729 for SEQ 991, in complement
gtaggaagagggtagaatttg

SEQ ID NO: 8857 - DNA, 20 bp, Homo Sapiens
  primer_bind 1..20: downstream amplification primer 99-1873 for SEQ 992, in complement
catggggaaacaaggaagag

SEQ ID NO: 8858 - DNA, 20 bp, Homo Sapiens
  primer_bind 1..20: downstream amplification primer 99-18744 for SEQ 993, in complement
tgataaaagcataaccctcc

SEQ ID NO: 8859 - DNA, 19 bp, Homo Sapiens
  primer_bind 1..19: downstream amplification primer 99-18745 for SEQ 994, in complement
gcccccttcatctatgctg

SEQ ID NO: 8860 - DNA, 21 bp, Homo Sapiens
  primer_bind 1..21: downstream amplification primer 99-18747 for SEQ 995, in complement
caaaggtacgctatacagctc

SEQ ID NO: 8861 - DNA, 18 bp, Homo Sapiens
  primer_bind 1..18: downstream amplification primer 99-18751 for SEQ 996, in complement
catccataggcattaagc

SEQ ID NO: 8862 - DNA, 18 bp, Homo Sapiens
  primer_bind 1..18: downstream amplification primer 99-18755 for SEQ 997, in complement
gacttgtcctgcacaaac

SEQ ID NO: 8863 - DNA, 21 bp, Homo Sapiens
  primer_bind 1..21: downstream amplification primer 99-18774 for SEQ 998, in complement
ataggcatattgatggggtgg

SEQ ID NO: 8864 - DNA, 21 bp, Homo Sapiens
  primer_bind 1..21: downstream amplification primer 99-18775 for SEQ 999, in complement
cgttagttattgatagcgggg

SEQ ID NO: 8865 - DNA, 21 bp, Homo Sapiens
  primer_bind 1..21: downstream amplification primer 99-18777 for SEQ 1000, in complement
ctgtgaaaaagagttcttttg

SEQ ID NO: 8866 - DNA, 21 bp, Homo Sapiens
  primer_bind 1..21: downstream amplification primer 99-18802 for SEQ 1001, in complement
tccaccagactctgagcatac

SEQ ID NO: 8867 - DNA, 18 bp, Homo Sapiens
  primer_bind 1..18: downstream amplification primer 99-18808 for SEQ 1002, in complement
ctaagagtgattcctgtg

SEQ ID NO: 8868 - DNA, 18 bp, Homo Sapiens
  primer_bind 1..18: downstream amplification primer 99-18814 for SEQ 1003, in complement
ctgtgtcttccctcaatg

SEQ ID NO: 8869 - DNA, 21 bp, Homo Sapiens
  primer_bind 1..21: downstream amplification primer 99-1882 for SEQ 1004, in complement
gcatctggacatttctgtatc

SEQ ID NO: 8870 - DNA, 20 bp, Homo Sapiens
  primer_bind 1..20: downstream amplification primer 99-18822 for SEQ 1005, in complement
tgcacatctttttcagttcc

SEQ ID NO: 8871 - DNA, 18 bp, Homo Sapiens
  primer_bind 1..18: downstream amplification primer 99-18826 for SEQ 1006, in complement
ctcagaatagaagcatcg

SEQ ID NO: 8872 - DNA, 21 bp, Homo Sapiens
  primer_bind 1..21: downstream amplification primer 99-18827 for SEQ 1007, in complement
gaaatgttgagagacatcgag

SEQ ID NO: 8873 - DNA, 21 bp, Homo Sapiens
  primer_bind 1..21: downstream amplification primer 99-1883 for SEQ 1008, in complement
caggaaaataatctcatctac

SEQ ID NO: 8874 - DNA, 19 bp, Homo Sapiens
  primer_bind 1..19: downstream amplification primer 99-18847 for SEQ 1009, in complement
ataaaagagtgttgtgtcc

SEQ ID NO: 8875 - DNA, 20 bp, Homo Sapiens
  primer_bind 1..20: downstream amplification primer 99-18853 for SEQ 1010, in complement
cacatttgagcacctactac

SEQ ID NO: 8876 - DNA, 21 bp, Homo Sapiens
  primer_bind 1..21: downstream amplification primer 99-18855 for SEQ 1011, in complement
aaacaaaactaagtgagttgc

SEQ ID NO: 8877 - DNA, 19 bp, Homo Sapiens
  primer_bind 1..19: downstream amplification primer 99-18860 for SEQ 1012, in complement
ccacggaaaatctctaaac

SEQ ID NO: 8878 - DNA, 21 bp, Homo Sapiens
  primer_bind 1..21: downstream amplification primer 99-18861 for SEQ 1013, in complement
ttgtagttttagcctttttcc

SEQ ID NO: 8879 - DNA, 20 bp, Homo Sapiens
  primer_bind 1..20: downstream amplification primer 99-1888 for SEQ 1014, in complement
gggttcagcagaaaagaatg

SEQ ID NO: 8880 - DNA, 21 bp, Homo Sapiens
  primer_bind 1..21: downstream amplification primer 99-1890 for SEQ 1015, in complement
ccttacaagctaacaaattac

SEQ ID NO: 8881 - DNA, 19 bp, Homo Sapiens
  primer_bind 1..19: downstream amplification primer 99-1895 for SEQ 1016, in complement
gctagtaaaattgtgcctc

SEQ ID NO: 8882 - DNA, 18 bp, Homo Sapiens
  primer_bind 1..18: downstream amplification primer 99-18974 for SEQ 1017, in complement
ttactcctacccacctac

SEQ ID NO: 8883 - DNA, 19 bp, Homo Sapiens
  primer_bind 1..19: downstream amplification primer 99-18976 for SEQ 1018, in complement
tcaacttaccaactgtgcc

SEQ ID NO: 8884 - DNA, 19 bp, Homo Sapiens
  primer_bind 1..19: downstream amplification primer 99-18982 for SEQ 1019, in complement
ggcttagactccatatttc

SEQ ID NO: 8885 - DNA, 18 bp, Homo Sapiens
  primer_bind 1..18: downstream amplification primer 99-18986 for SEQ 1020, in complement
tctcctgataagaccgcc

SEQ ID NO: 8886 - DNA, 20 bp, Homo Sapiens
  primer_bind 1..20: downstream amplification primer 99-18987 for SEQ 1021, in complement
ccttgaacgaaactttgtcc

SEQ ID NO: 8887 - DNA, 18 bp, Homo Sapiens
  primer_bind 1..18: downstream amplification primer 99-18995 for SEQ 1022, in complement
agccacatggaacctttg

SEQ ID NO: 8888 - DNA, 21 bp, Homo Sapiens
  primer_bind 1..21: downstream amplification primer 99-18996 for SEQ 1023, in complement
gcaaatcatataacactctcc

SEQ ID NO: 8889 - DNA, 20 bp, Homo Sapiens
  primer_bind 1..20: downstream amplification primer 99-19008 for SEQ 1024, in complement
gtgctcttatctgttagatg

SEQ ID NO: 8890 - DNA, 21 bp, Homo Sapiens
  primer_bind 1..21: downstream amplification primer 99-19013 for SEQ 1025, in complement
gtgtatgtgtgtaggtttgag

SEQ ID NO: 8891 - DNA, 18 bp, Homo Sapiens
  primer_bind 1..18: downstream amplification primer 99-19016 for SEQ 1026, in complement
gacagcagatgagcttgg

SEQ ID NO: 8892 - DNA, 20 bp, Homo Sapiens
  primer_bind 1..20: downstream amplification primer 99-1909 for SEQ 1027, in complement
actgttaatctacatgagtg

SEQ ID NO: 8893 - DNA, 18 bp, Homo Sapiens
  primer_bind 1..18: downstream amplification primer 99-1910 for SEQ 1028, in complement
cgcattgattcttgttcc

SEQ ID NO: 8894 - DNA, 21 bp, Homo Sapiens
  primer_bind 1..21: downstream amplification primer 99-1916 for SEQ 1029, in complement
atgataaacagccattagcac

SEQ ID NO: 8895 - DNA, 21 bp, Homo Sapiens
  primer_bind 1..21: downstream amplification primer 99-1917 for SEQ 1030, in complement
tttttccatcaggtgatacgg

SEQ ID NO: 8896 - DNA, 19 bp, Homo Sapiens
  primer_bind 1..19: downstream amplification primer 99-19253 for SEQ 1031, in complement
cattggcagtattttcaag

SEQ ID NO: 8897 - DNA, 19 bp, Homo Sapiens
  primer_bind 1..19: downstream amplification primer 99-19256 for SEQ 1032, in complement
ttaagatggattaggactc

SEQ ID NO: 8898 - DNA, 21 bp, Homo Sapiens
  primer_bind 1..21: downstream amplification primer 99-1934 for SEQ 1033, in complement
tttatcccctccagaaaatgc

SEQ ID NO: 8899 - DNA, 21 bp, Homo Sapiens
  primer_bind 1..21: downstream amplification primer 99-1936 for SEQ 1034, in complement
acataacataacctctttacc

SEQ ID NO: 8900 - DNA, 18 bp, Homo Sapiens
  primer_bind 1..18: downstream amplification primer 99-1944 for SEQ 1035, in complement
tggcattcccatgttctc

SEQ ID NO: 8901 - DNA, 20 bp, Homo Sapiens
  primer_bind 1..20: downstream amplification primer 99-1947 for SEQ 1036, in complement
cagtctgattttgaggatag

SEQ ID NO: 8902 - DNA, 19 bp, Homo Sapiens
  primer_bind 1..19: downstream amplification primer 99-1948 for SEQ 1037, in complement
aacaacacataagtcaagg

SEQ ID NO: 8903 - DNA, 21 bp, Homo Sapiens
  primer_bind 1..21: downstream amplification primer 99-1953 for SEQ 1038, in complement
tacgatagcaagtgtgttcag

SEQ ID NO: 8904 - DNA, 18 bp, Homo Sapiens
  primer_bind 1..18: downstream amplification primer 99-1955 for SEQ 1039, in complement
ggtttaagagttgtggag

SEQ ID NO: 8905 - DNA, 21 bp, Homo Sapiens
  primer_bind 1..21: downstream amplification primer 99-1960 for SEQ 1040, in complement
tacatgctacaaatgatgtgg

SEQ ID NO: 8906 - DNA, 19 bp, Homo Sapiens
  primer_bind 1..19: downstream amplification primer 99-1964 for SEQ 1041, in complement
gtgttgatcttgtcttctg

SEQ ID NO: 8907 - DNA, 19 bp, Homo Sapiens
  primer_bind 1..19: downstream amplification primer 99-1977 for SEQ 1042, in complement
taaacaaagagagacatgg

SEQ ID NO: 8908 - DNA, 20 bp, Homo Sapiens
  primer_bind 1..20: downstream amplification primer 99-1997 for SEQ 1043, in complement
agccaaatgaacaaatagag

SEQ ID NO: 8909 - DNA, 21 bp, Homo Sapiens
  primer_bind 1..21: downstream amplification primer 99-19999 for SEQ 1044, in complement
cttactcacatagatactgcc

SEQ ID NO: 8910 - DNA, 18 bp, Homo Sapiens
  primer_bind 1..18: downstream amplification primer 99-2000 for SEQ 1045, in complement
tgagtttttgtgaagggg

SEQ ID NO: 8911 - DNA, 19 bp, Homo Sapiens
  primer_bind 1..19: downstream amplification primer 99-20000 for SEQ 1046, in complement
ctattccatttctcaatcc

SEQ ID NO: 8912 - DNA, 21 bp, Homo Sapiens
  primer_bind 1..21: downstream amplification primer 99-2001 for SEQ 1047, in complement
tatcctctttgttttgtcacc

SEQ ID NO: 8913 - DNA, 21 bp, Homo Sapiens
  primer_bind 1..21: downstream amplification primer 99-20011 for SEQ 1048, in complement
tagtgctatggggcttacagg

SEQ ID NO: 8914 - DNA, 21 bp, Homo Sapiens
  primer_bind 1..21: downstream amplification primer 99-20018 for SEQ 1049, in complement
gtcatttgaatatcaacacac

SEQ ID NO: 8915 - DNA, 18 bp, Homo Sapiens
  primer_bind 1..18: downstream amplification primer 99-20023 for SEQ 1050, in complement
ggatttagcggctgaatg

SEQ ID NO: 8916 - DNA, 19 bp, Homo Sapiens
  primer_bind 1..19: downstream amplification primer 99-2003 for SEQ 1051, in complement
ataatggacgactgatttc

SEQ ID NO: 8917 - DNA, 18 bp, Homo Sapiens
  primer_bind 1..18: downstream amplification primer 99-20032 for SEQ 1052, in complement
ttcccacactactcaaac

SEQ ID NO: 8918 - DNA, 18 bp, Homo Sapiens
  primer_bind 1..18: downstream amplification primer 99-20033 for SEQ 1053, in complement
tctcgcagcagtgaggac

SEQ ID NO: 8919 - DNA, 21 bp, Homo Sapiens
  primer_bind 1..21: downstream amplification primer 99-20035 for SEQ 1054, in complement
gtttatatctctttggctggg

SEQ ID NO: 8920 - DNA, 21 bp, Homo Sapiens
  primer_bind 1..21: downstream amplification primer 99-2004 for SEQ 1055, in complement
gaacgacaccttatttaattg

SEQ ID NO: 8921 - DNA, 18 bp, Homo Sapiens
  primer_bind 1..18: downstream amplification primer 99-2005 for SEQ 1056, in complement
agtagcttgtgtggcatc

SEQ ID NO: 8922 - DNA, 21 bp, Homo Sapiens
  primer_bind 1..21: downstream amplification primer 99-20057 for SEQ 1057, in complement
gatatttatatgagggagagg

SEQ ID NO: 8923 - DNA, 21 bp, Homo Sapiens
  primer_bind 1..21: downstream amplification primer 99-20061 for SEQ 1058, in complement
cctttggagacttagtgagtg

SEQ ID NO: 8924 - DNA, 20 bp, Homo Sapiens
  primer_bind 1..20: downstream amplification primer 99-20062 for SEQ 1059, in complement
aattggaaggaaaactgttg

SEQ ID NO: 8925 - DNA, 21 bp, Homo Sapiens
  primer_bind 1..21: downstream amplification primer 99-2007 for SEQ 1060, in complement
ttgagtggagaaaattcacgg

SEQ ID NO: 8926 - DNA, 21 bp, Homo Sapiens
  primer_bind 1..21: downstream amplification primer 99-20074 for SEQ 1061, in complement
atagcacgaatgggagattgg

SEQ ID NO: 8927 - DNA, 19 bp, Homo Sapiens
  primer_bind 1..19: downstream amplification primer 99-20090 for SEQ 1062, in complement
cacagatacagaatggtag

SEQ ID NO: 8928 - DNA, 20 bp, Homo Sapiens
  primer_bind 1..20: downstream amplification primer 99-2010 for SEQ 1063, in complement
aactactttcaaatgccacc

SEQ ID NO: 8929 - DNA, 21 bp, Homo Sapiens
  primer_bind 1..21: downstream amplification primer 99-20110 for SEQ 1064, in complement
ttccagtagccagtgtatcag

SEQ ID NO: 8930 - DNA, 19 bp, Homo Sapiens
  primer_bind 1..19: downstream amplification primer 99-2012 for SEQ 1065, in complement
tgcagtttttcaacaagtc

SEQ ID NO: 8931 - DNA, 18 bp, Homo Sapiens
  primer_bind 1..18: downstream amplification primer 99-20154 for SEQ 1066, in complement
ccctgccacataacaatg

SEQ ID NO: 8932 - DNA, 18 bp, Homo Sapiens
  primer_bind 1..18: downstream amplification primer 99-20156 for SEQ 1067, in complement
cagatgggatgaagagtg

SEQ ID NO: 8933 - DNA, 21 bp, Homo Sapiens
  primer_bind 1..21: downstream amplification primer 99-20198 for SEQ 1068, in complement
tgcatgactgtatctccttcc

SEQ ID NO: 8934 - DNA, 19 bp, Homo Sapiens
  primer_bind 1..19: downstream amplification primer 99-2020 for SEQ 1069, in complement
gcacaggctaaacaatcac

SEQ ID NO: 8935 - DNA, 21 bp, Homo Sapiens
  primer_bind 1..21: downstream amplification primer 99-20208 for SEQ 1070, in complement
gtattgattcactcacagttg

SEQ ID NO: 8936 - DNA, 21 bp, Homo Sapiens
  primer_bind 1..21: downstream amplification primer 99-2022 for SEQ 1071, in complement
aacacactaattttctctgcc

SEQ ID NO: 8937 - DNA, 18 bp, Homo Sapiens
  primer_bind 1..18: downstream amplification primer 99-2024 for SEQ 1072, in complement
gcagaactgcattagtgg

SEQ ID NO: 8938 - DNA, 19 bp, Homo Sapiens
  primer_bind 1..19: downstream amplification primer 99-2025 for SEQ 1073, in complement
gcagagagatcataagagc

SEQ ID NO: 8939 - DNA, 18 bp, Homo Sapiens
  primer_bind 1..18: downstream amplification primer 99-20250 for SEQ 1074, in complement
gctctggaatgtgccctc

SEQ ID NO: 8940 - DNA, 20 bp, Homo Sapiens
  primer_bind 1..20: downstream amplification primer 99-2027 for SEQ 1075, in complement
agagctgaagtgtaaataag

SEQ ID NO: 8941 - DNA, 21 bp, Homo Sapiens
  primer_bind 1..21: downstream amplification primer 99-20294 for SEQ 1076, in complement
cctcagatccatcccagaatc

SEQ ID NO: 8942 - DNA, 20 bp, Homo Sapiens
  primer_bind 1..20: downstream amplification primer 99-20303 for SEQ 1077, in complement
tttaccagggtcattctttc

SEQ ID NO: 8943 - DNA, 21 bp, Homo Sapiens
  primer_bind 1..21: downstream amplification primer 99-20313 for SEQ 1078, in complement
actattgtcaatcctctcttc

SEQ ID NO: 8944 - DNA, 18 bp, Homo Sapiens
  primer_bind 1..18: downstream amplification primer 99-20320 for SEQ 1079, in complement
gaaatgacgatacaagcc

SEQ ID NO: 8945 - DNA, 21 bp, Homo Sapiens
  primer_bind 1..21: downstream amplification primer 99-20326 for SEQ 1080, in complement
ttgggaggggtaggataatgg

SEQ ID NO: 8946 - DNA, 21 bp, Homo Sapiens
  primer_bind 1..21: downstream amplification primer 99-20332 for SEQ 1081, in complement
tagacactgagtacatcatgg

SEQ ID NO: 8947 - DNA, 19 bp, Homo Sapiens
  primer_bind 1..19: downstream amplification primer 99-20335 for SEQ 1082, in complement
catttttcatgttgactgc

SEQ ID NO: 8948 - DNA, 21 bp, Homo Sapiens
  primer_bind 1..21: downstream amplification primer 99-20340 for SEQ 1083, in complement
cagtttatttgggaagacagg

SEQ ID NO: 8949 - DNA, 19 bp, Homo Sapiens
  primer_bind 1..19: downstream amplification primer 99-20348 for SEQ 1084, in complement
cagtgtatgtgtgtattac

SEQ ID NO: 8950 - DNA, 18 bp, Homo Sapiens
  primer_bind 1..18: downstream amplification primer 99-2035 for SEQ 1085, in complement
cacacaaggatacagtgg

SEQ ID NO: 8951 - DNA, 20 bp, Homo Sapiens
  primer_bind 1..20: downstream amplification primer 99-20353 for SEQ 1086, in complement
aatcagaaaggcagtgttag

SEQ ID NO: 8952 - DNA, 19 bp, Homo Sapiens
  primer_bind 1..19: downstream amplification primer 99-20357 for SEQ 1087, in complement
cggtcattccttttctctc

SEQ ID NO: 8953 - DNA, 18 bp, Homo Sapiens
  primer_bind 1..18: downstream amplification primer 99-2036 for SEQ 1088, in complement
gcctggatagaagtttag

SEQ ID NO: 8954 - DNA, 18 bp, Homo Sapiens
  primer_bind 1..18: downstream amplification primer 99-2037 for SEQ 1089, in complement
gaaccacagaatccagag

SEQ ID NO: 8955 - DNA, 21 bp, Homo Sapiens
  primer_bind 1..21: downstream amplification primer 99-20385 for SEQ 1090, in complement
gtccttgaaagaaaggtaaag

SEQ ID NO: 8956 - DNA, 18 bp, Homo Sapiens
  primer_bind 1..18: downstream amplification primer 99-2041 for SEQ 1091, in complement
catccacgacctcctaag

SEQ ID NO: 8957 - DNA, 21 bp, Homo Sapiens
  primer_bind 1..21: downstream amplification primer 99-2042 for SEQ 1092, in complement
tttattctccttcctgccacc

SEQ ID NO: 8958 - DNA, 21 bp, Homo Sapiens
  primer_bind 1..21: downstream amplification primer 99-20420 for SEQ 1093, in complement
cctcagatccatcccagaatc

SEQ ID NO: 8959 - DNA, 18 bp, Homo Sapiens
  primer_bind 1..18: downstream amplification primer 99-20423 for SEQ 1094, in complement
tttaaggtctccttcctg

SEQ ID NO: 8960 - DNA, 20 bp, Homo Sapiens
  primer_bind 1..20: downstream amplification primer 99-20424 for SEQ 1095, in complement
acaggaaaagtccccgagag

SEQ ID NO: 8961 - DNA, 21 bp, Homo Sapiens
  primer_bind 1..21: downstream amplification primer 99-20428 for SEQ 1096, in complement
gtgtttgttgtttggtaatag

SEQ ID NO: 8962 - DNA, 21 bp, Homo Sapiens
  primer_bind 1..21: downstream amplification primer 99-2043 for SEQ 1097, in complement
aaatccgcataatccaaaccg

SEQ ID NO: 8963 - DNA, 21 bp, Homo Sapiens
  primer_bind 1..21: downstream amplification primer 99-2046 for SEQ 1098, in complement
aaacaaagtgtttcctcctcc

SEQ ID NO: 8964 - DNA, 21 bp, Homo Sapiens
  primer_bind 1..21: downstream amplification primer 99-20469 for SEQ 1099, in complement
taataagatactgcacactcc

SEQ ID NO: 8965 - DNA, 21 bp, Homo Sapiens
  primer_bind 1..21: downstream amplification primer 99-2048 for SEQ 1100, in complement
cacatgagtatgagcataagg

SEQ ID NO: 8966 - DNA, 20 bp, Homo Sapiens
  primer_bind 1..20: downstream amplification primer 99-20480 for SEQ 1101, in complement
ggcgttgttgaaaattgctc

SEQ ID NO: 8967 - DNA, 21 bp, Homo Sapiens
  primer_bind 1..21: downstream amplification primer 99-20481 for SEQ 1102, in complement
gcatcagaaattaagatagag

SEQ ID NO: 8968 - DNA, 20 bp, Homo Sapiens
  primer_bind 1..20: downstream amplification primer 99-20485 for SEQ 1103, in complement
acagggggtcttaaatcggg

SEQ ID NO: 8969 - DNA, 20 bp, Homo Sapiens
  primer_bind 1..20: downstream amplification primer 99-20493 for SEQ 1104, in complement
tctgtgtcccatgtcttgcc

SEQ ID NO: 8970 - DNA, 21 bp, Homo Sapiens
  primer_bind 1..21: downstream amplification primer 99-20499 for SEQ 1105, in complement
atgtataaagcctgcctggtg

SEQ ID NO: 8971 - DNA, 21 bp, Homo Sapiens
  primer_bind 1..21: downstream amplification primer 99-20504 for SEQ 1106, in complement
tcatttctccctctcgaaacc

SEQ ID NO: 8972 - DNA, 21 bp, Homo Sapiens
  primer_bind 1..21: downstream amplification primer 99-20508 for SEQ 1107, in complement
tattcagtcatctgctgttcg

SEQ ID NO: 8973 - DNA, 18 bp, Homo Sapiens
  primer_bind 1..18: downstream amplification primer 99-2051 for SEQ 1108, in complement
aggtgaggaagtagaagg

SEQ ID NO: 8974 - DNA, 21 bp, Homo Sapiens
  primer_bind 1..21: downstream amplification primer 99-20511 for SEQ 1109, in complement
agactctgttcctgatttgcc

SEQ ID NO: 8975 - DNA, 20 bp, Homo Sapiens
  primer_bind 1..20: downstream amplification primer 99-20514 for SEQ 1110, in complement
aaagtctcttttaggctgtc

SEQ ID NO: 8976 - DNA, 19 bp, Homo Sapiens
  primer_bind 1..19: downstream amplification primer 99-20518 for SEQ 1111, in complement
ttattcataacacccctac

SEQ ID NO: 8977 - DNA, 20 bp, Homo Sapiens
  primer_bind 1..20: downstream amplification primer 99-2052 for SEQ 1112, in complement
catgttcaaagaagcaaacc

SEQ ID NO: 8978 - DNA, 21 bp, Homo Sapiens
  primer_bind 1..21: downstream amplification primer 99-20527 for SEQ 1113, in complement
tcaataagcatctcttctcac

SEQ ID NO: 8979 - DNA, 20 bp, Homo Sapiens
  primer_bind 1..20: downstream amplification primer 99-2053 for SEQ 1114, in complement
gtaaattgctcatttgcatc

SEQ ID NO: 8980 - DNA, 21 bp, Homo Sapiens
  primer_bind 1..21: downstream amplification primer 99-20531 for SEQ 1115, in complement
gagaagttattcaatgagaag

SEQ ID NO: 8981 - DNA, 21 bp, Homo Sapiens
  primer_bind 1..21: downstream amplification primer 99-2054 for SEQ 1116, in complement
tgtgtgatgggaaaattaagg

SEQ ID NO: 8982 - DNA, 19 bp, Homo Sapiens
  primer_bind 1..19: downstream amplification primer 99-20542 for SEQ 1117, in complement
ggacatttttcagtaggag

SEQ ID NO: 8983 - DNA, 19 bp, Homo Sapiens
  primer_bind 1..19: downstream amplification primer 99-20549 for SEQ 1118, in complement
ggtatcccataaatacctc

SEQ ID NO: 8984 - DNA, 21 bp, Homo Sapiens
  primer_bind 1..21: downstream amplification primer 99-2055 for SEQ 1119, in complement
tctacatgcttcaatgatgac

SEQ ID NO: 8985 - DNA, 21 bp, Homo Sapiens
  primer_bind 1..21: downstream amplification primer 99-20552 for SEQ 1120, in complement
acatccatatagaaaaggcac

SEQ ID NO: 8986 - DNA, 18 bp, Homo Sapiens
  primer_bind 1..18: downstream amplification primer 99-2056 for SEQ 1121, in complement
taggtctacagttgctac

SEQ ID NO: 8987 - DNA, 18 bp, Homo Sapiens
  primer_bind 1..18: downstream amplification primer 99-20561 for SEQ 1122, in complement
ctctggcttattttcctg

SEQ ID NO: 8988 - DNA, 19 bp, Homo Sapiens
  primer_bind 1..19: downstream amplification primer 99-20565 for SEQ 1123, in complement
acatcagctattcccagtc

SEQ ID NO: 8989 - DNA, 20 bp, Homo Sapiens
  primer_bind 1..20: downstream amplification primer 99-20566 for SEQ 1124, in complement
ccccaaattagcttatttac

SEQ ID NO: 8990 - DNA, 21 bp, Homo Sapiens
  primer_bind 1..21: downstream amplification primer 99-20567 for SEQ 1125, in complement
cactattccttttctctatac

SEQ ID NO: 8991 - DNA, 18 bp, Homo Sapiens
  primer_bind 1..18: downstream amplification primer 99-20568 for SEQ 1126, in complement
tcagtagagttgggattc

SEQ ID NO: 8992 - DNA, 18 bp, Homo Sapiens
  primer_bind 1..18: downstream amplification primer 99-2058 for SEQ 1127, in complement
tgggactcactcactcac

SEQ ID NO: 8993 - DNA, 18 bp, Homo Sapiens
  primer_bind 1..18: downstream amplification primer 99-20581 for SEQ 1128, in complement
gcaaaccactcatccatc

SEQ ID NO: 8994 - DNA, 21 bp, Homo Sapiens
  primer_bind 1..21: downstream amplification primer 99-20594 for SEQ 1129, in complement
ttccctctgagatagattttc

SEQ ID NO: 8995 - DNA, 18 bp, Homo Sapiens
  primer_bind 1..18: downstream amplification primer 99-2060 for SEQ 1130, in complement
gaatcttaatggctgtgg

SEQ ID NO: 8996 - DNA, 21 bp, Homo Sapiens
  primer_bind 1..21: downstream amplification primer 99-2061 for SEQ 1131, in complement
tctatgcactcccgcaataac

SEQ ID NO: 8997 - DNA, 18 bp, Homo Sapiens
  primer_bind 1..18: downstream amplification primer 99-20616 for SEQ 1132, in complement
agggatttgcggtctttg

SEQ ID NO: 8998 - DNA, 18 bp, Homo Sapiens
  primer_bind 1..18: downstream amplification primer 99-20623 for SEQ 1133, in complement
gtaatttggggaagggag

SEQ ID NO: 8999 - DNA, 20 bp, Homo Sapiens
  primer_bind 1..20: downstream amplification primer 99-2063 for SEQ 1134, in complement
gaaacattctgaacttttgg

SEQ ID NO: 9000 - DNA, 21 bp, Homo Sapiens
  primer_bind 1..21: downstream amplification primer 99-20639 for SEQ 1135, in complement
gaagtaattgcttgaatatcc

SEQ ID NO: 9001 - DNA, 21 bp, Homo Sapiens
  primer_bind 1..21: downstream amplification primer 99-20642 for SEQ 1136, in complement
gtctcatttgtgacaactagg

SEQ ID NO: 9002 - DNA, 18 bp, Homo Sapiens
  primer_bind 1..18: downstream amplification primer 99-20651 for SEQ 1137, in complement
aattgtgggagacaagtg

SEQ ID NO: 9003 - DNA, 21 bp, Homo Sapiens
  primer_bind 1..21: downstream amplification primer 99-20656 for SEQ 1138, in complement
gaattatgaaatgtgtgtgtg

SEQ ID NO: 9004 - DNA, 21 bp, Homo Sapiens
  primer_bind 1..21: downstream amplification primer 99-20659 for SEQ 1139, in complement
ttgctttcctgcttgtgattg

SEQ ID NO: 9005 - DNA, 18 bp, Homo Sapiens
  primer_bind 1..18: downstream amplification primer 99-20675 for SEQ 1140, in complement
cacttctatcccttccac

SEQ ID NO: 9006 - DNA, 18 bp, Homo Sapiens
  primer_bind 1..18: downstream amplification primer 99-20677 for SEQ 1141, in complement
tgttagtctatgctctcc

SEQ ID NO: 9007 - DNA, 18 bp, Homo Sapiens
  primer_bind 1..18: downstream amplification primer 99-20683 for SEQ 1142, in complement
gaggtcagcattatgtag

SEQ ID NO: 9008 - DNA, 21 bp, Homo Sapiens
  primer_bind 1..21: downstream amplification primer 99-20688 for SEQ 1143, in complement
aggtggtatattgagaaaaag

SEQ ID NO: 9009 - DNA, 21 bp, Homo Sapiens
  primer_bind 1..21: downstream amplification primer 99-20723 for SEQ 1144, in complement
ctgttttcttgtgggtgatgg

SEQ ID NO: 9010 - DNA, 21 bp, Homo Sapiens
  primer_bind 1..21: downstream amplification primer 99-20726 for SEQ 1145, in complement
agtcaaaccaattatgagaag

SEQ ID NO: 9011 - DNA, 20 bp, Homo Sapiens
  primer_bind 1..20: downstream amplification primer 99-20732 for SEQ 1146, in complement
taaatatcttcggcgtattc

SEQ ID NO: 9012 - DNA, 19 bp, Homo Sapiens
  primer_bind 1..19: downstream amplification primer 99-20738 for SEQ 1147, in complement
gttgttgtatcatttggtc

SEQ ID NO: 9013 - DNA, 21 bp, Homo Sapiens
  primer_bind 1..21: downstream amplification primer 99-20739 for SEQ 1148, in complement
tacattgcctgttgtgatacc

SEQ ID NO: 9014 - DNA, 18 bp, Homo Sapiens
  primer_bind 1..18: downstream amplification primer 99-2074 for SEQ 1149, in complement
cacaatatctcacgtacc

SEQ ID NO: 9015 - DNA, 21 bp, Homo Sapiens
  primer_bind 1..21: downstream amplification primer 99-20746 for SEQ 1150, in complement
aacaaatcttaaaagccagac

SEQ ID NO: 9016 - DNA, 19 bp, Homo Sapiens
  primer_bind 1..19: downstream amplification primer 99-20747 for SEQ 1151, in complement
ttcttaatgtctctaaccc

SEQ ID NO: 9017 - DNA, 19 bp, Homo Sapiens
  primer_bind 1..19: downstream amplification primer 99-20766 for SEQ 1152, in complement
tactatgaggcagaagggg

SEQ ID NO: 9018 - DNA, 18 bp, Homo Sapiens
  primer_bind 1..18: downstream amplification primer 99-20768 for SEQ 1153, in complement
ttttgtttccatccctcc

SEQ ID NO: 9019 - DNA, 19 bp, Homo Sapiens
  primer_bind 1..19: downstream amplification primer 99-2077 for SEQ 1154, in complement
ataatggacgactgatttc

SEQ ID NO: 9020 - DNA, 21 bp, Homo Sapiens
  primer_bind 1..21: downstream amplification primer 99-20771 for SEQ 1155, in complement
aaatccaccttcaccttcttc

SEQ ID NO: 9021 - DNA, 20 bp, Homo Sapiens
  primer_bind 1..20: downstream amplification primer 99-2078 for SEQ 1156, in complement
ataggttccaagtcattagg

SEQ ID NO: 9022 - DNA, 18 bp, Homo Sapiens
  primer_bind 1..18: downstream amplification primer 99-20797 for SEQ 1157, in complement
tgctgtgtgtgacaagtg

SEQ ID NO: 9023 - DNA, 21 bp, Homo Sapiens
  primer_bind 1..21: downstream amplification primer 99-20798 for SEQ 1158, in complement
ttttactgtgttgctcttttg

SEQ ID NO: 9024 - DNA, 21 bp, Homo Sapiens
  primer_bind 1..21: downstream amplification primer 99-2080 for SEQ 1159, in complement
agaagaaatgagagaggacag

SEQ ID NO: 9025 - DNA, 21 bp, Homo Sapiens
  primer_bind 1..21: downstream amplification primer 99-20802 for SEQ 1160, in complement
tctaagtatgtcagttccttc

SEQ ID NO: 9026 - DNA, 21 bp, Homo Sapiens
  primer_bind 1..21: downstream amplification primer 99-20814 for SEQ 1161, in complement
tattgtatgacgaaaactggg

SEQ ID NO: 9027 - DNA, 21 bp, Homo Sapiens
  primer_bind 1..21: downstream amplification primer 99-2082 for SEQ 1162, in complement
ctgtgtctcagtgctaactgg

SEQ ID NO: 9028 - DNA, 19 bp, Homo Sapiens
  primer_bind 1..19: downstream amplification primer 99-20823 for SEQ 1163, in complement
tgtggtatatgtgaaaacg

SEQ ID NO: 9029 - DNA, 18 bp, Homo Sapiens
  primer_bind 1..18: downstream amplification primer 99-20828 for SEQ 1164, in complement
ttaagatgggagaggtag

SEQ ID NO: 9030 - DNA, 18 bp, Homo Sapiens
  primer_bind 1..18: downstream amplification primer 99-20830 for SEQ 1165, in complement
agtggtaatgagttgctg

SEQ ID NO: 9031 - DNA, 19 bp, Homo Sapiens
  primer_bind 1..19: downstream amplification primer 99-2084 for SEQ 1166, in complement
ttttgctttatgatgccac

SEQ ID NO: 9032 - DNA, 19 bp, Homo Sapiens
  primer_bind 1..19: downstream amplification primer 99-2085 for SEQ 1167, in complement
gaggaatcagggaagaagg

SEQ ID NO: 9033 - DNA, 18 bp, Homo Sapiens
  primer_bind 1..18: downstream amplification primer 99-20850 for SEQ 1168, in complement
taagttgtgtcagcaagg

SEQ ID NO: 9034 - DNA, 18 bp, Homo Sapiens
  primer_bind 1..18: downstream amplification primer 99-20853 for SEQ 1169, in complement
tagtccttctaccatgtc

SEQ ID NO: 9035 - DNA, 21 bp, Homo Sapiens
  primer_bind 1..21: downstream amplification primer 99-20856 for SEQ 1170, in complement
attttgatctgtcaactgaac

SEQ ID NO: 9036 - DNA, 19 bp, Homo Sapiens
  primer_bind 1..19: downstream amplification primer 99-20867 for SEQ 1171, in complement
aaagtataaacagggacag

SEQ ID NO: 9037 - DNA, 21 bp, Homo Sapiens
  primer_bind 1..21: downstream amplification primer 99-20872 for SEQ 1172, in complement
aatttagtttggagagtttgg

SEQ ID NO: 9038 - DNA, 21 bp, Homo Sapiens
  primer_bind 1..21: downstream amplification primer 99-20883 for SEQ 1173, in complement
gatggtggtgtgataaataag

SEQ ID NO: 9039 - DNA, 21 bp, Homo Sapiens
  primer_bind 1..21: downstream amplification primer 99-20887 for SEQ 1174, in complement
ctcccagtatgtttaagctcc

SEQ ID NO: 9040 - DNA, 18 bp, Homo Sapiens
  primer_bind 1..18: downstream amplification primer 99-2089 for SEQ 1175, in complement
tccaactccttgtctctc

SEQ ID NO: 9041 - DNA, 21 bp, Homo Sapiens
  primer_bind 1..21: downstream amplification primer 99-20895 for SEQ 1176, in complement
gtgtggtactagcacatgaac

SEQ ID NO: 9042 - DNA, 21 bp, Homo Sapiens
  primer_bind 1..21: downstream amplification primer 99-2092 for SEQ 1177, in complement
ttcactaccaacatctccatc

SEQ ID NO: 9043 - DNA, 19 bp, Homo Sapiens
  primer_bind 1..19: downstream amplification primer 99-20928 for SEQ 1178, in complement
tgttcttgtttgctaatcc

SEQ ID NO: 9044 - DNA, 21 bp, Homo Sapiens
  primer_bind 1..21: downstream amplification primer 99-2093 for SEQ 1179, in complement
tggttaatagtatggagggtg

SEQ ID NO: 9045 - DNA, 21 bp, Homo Sapiens
  primer_bind 1..21: downstream amplification primer 99-20938 for SEQ 1180, in complement
tgaattacaatggaaatgagg

SEQ ID NO: 9046 - DNA, 21 bp, Homo Sapiens
  primer_bind 1..21: downstream amplification primer 99-2094 for SEQ 1181, in complement
gataatgagaaggacccaaag

SEQ ID NO: 9047 - DNA, 18 bp, Homo Sapiens
  primer_bind 1..18: downstream amplification primer 99-20950 for SEQ 1182, in complement
aactgaggcatttgttgg

SEQ ID NO: 9048 - DNA, 20 bp, Homo Sapiens
  primer_bind 1..20: downstream amplification primer 99-2098 for SEQ 1183, in complement
cccattacaaaatggaaaac

SEQ ID NO: 9049 - DNA, 21 bp, Homo Sapiens
  primer_bind 1..21: downstream amplification primer 99-21012 for SEQ 1184, in complement
gactatatgcaagacaggaac

SEQ ID NO: 9050 - DNA, 20 bp, Homo Sapiens
  primer_bind 1..20: downstream amplification primer 99-21021 for SEQ 1185, in complement
tgactatcctgctgttcgtg

SEQ ID NO: 9051 - DNA, 20 bp, Homo Sapiens
  primer_bind 1..20: downstream amplification primer 99-2103 for SEQ 1186, in complement
gtcttcataagtcttcagtg

SEQ ID NO: 9052 - DNA, 21 bp, Homo Sapiens
  primer_bind 1..21: downstream amplification primer 99-21035 for SEQ 1187, in complement
tcaacaagttcacgccaagcc

SEQ ID NO: 9053 - DNA, 18 bp, Homo Sapiens
  primer_bind 1..18: downstream amplification primer 99-21064 for SEQ 1188, in complement
tgacaactaccagaagtg

SEQ ID NO: 9054 - DNA, 20 bp, Homo Sapiens
  primer_bind 1..20: downstream amplification primer 99-21070 for SEQ 1189, in complement
tacaatttttacaggagagg

SEQ ID NO: 9055 - DNA, 19 bp, Homo Sapiens
  primer_bind 1..19: downstream amplification primer 99-21079 for SEQ 1190, in complement
gatccaagttaaaaaggag

SEQ ID NO: 9056 - DNA, 20 bp, Homo Sapiens
  primer_bind 1..20: downstream amplification primer 99-21084 for SEQ 1191, in complement
gctcaaaataaatgtagtgg

SEQ ID NO: 9057 - DNA, 19 bp, Homo Sapiens
  primer_bind 1..19: downstream amplification primer 99-2109 for SEQ 1192, in complement
ttgtgaattacaagtaccc

SEQ ID NO: 9058 - DNA, 20 bp, Homo Sapiens
  primer_bind 1..20: downstream amplification primer 99-211 for SEQ 1193, in complement
ctgtgtttaagtgactgctg

SEQ ID NO: 9059 - DNA, 21 bp, Homo Sapiens
  primer_bind 1..21: downstream amplification primer 99-21141 for SEQ 1194, in complement
gtgaagttggagaagtagaag

SEQ ID NO: 9060 - DNA, 18 bp, Homo Sapiens
  primer_bind 1..18: downstream amplification primer 99-21148 for SEQ 1195, in complement
tcccccctaaaataaacc

SEQ ID NO: 9061 - DNA, 20 bp, Homo Sapiens
  primer_bind 1..20: downstream amplification primer 99-21149 for SEQ 1196, in complement
aatggtgagcacctgctaac

SEQ ID NO: 9062 - DNA, 19 bp, Homo Sapiens
  primer_bind 1..19: downstream amplification primer 99-21167 for SEQ 1197, in complement
gaactgaaagagcaatgcc

SEQ ID NO: 9063 - DNA, 21 bp, Homo Sapiens
  primer_bind 1..21: downstream amplification primer 99-2117 for SEQ 1198, in complement
atgccaagctgctcttagctc

SEQ ID NO: 9064 - DNA, 21 bp, Homo Sapiens
  primer_bind 1..21: downstream amplification primer 99-21221 for SEQ 1199, in complement
caaaggatgcttcatcaagag

SEQ ID NO: 9065 - DNA, 21 bp, Homo Sapiens
  primer_bind 1..21: downstream amplification primer 99-2126 for SEQ 1200, in complement
agaatagtgagtttgatagag

SEQ ID NO: 9066 - DNA, 20 bp, Homo Sapiens
  primer_bind 1..20: downstream amplification primer 99-21370 for SEQ 1201, in complement
ggggaggttgaagaattggg

SEQ ID NO: 9067 - DNA, 21 bp, Homo Sapiens
  primer_bind 1..21: downstream amplification primer 99-2170 for SEQ 1202, in complement
ggtcttcttgtgcttagaaac

SEQ ID NO: 9068 - DNA, 21 bp, Homo Sapiens
  primer_bind 1..21: downstream amplification primer 99-2172 for SEQ 1203, in complement
ctacaattatagtgtagaagg

SEQ ID NO: 9069 - DNA, 18 bp, Homo Sapiens
  primer_bind 1..18: downstream amplification primer 99-2173 for SEQ 1204, in complement
gaaagagttcctttctcc

SEQ ID NO: 9070 - DNA, 21 bp, Homo Sapiens
  primer_bind 1..21: downstream amplification primer 99-2179 for SEQ 1205, in complement
cttttatcgggaacttgagac

SEQ ID NO: 9071 - DNA, 20 bp, Homo Sapiens
  primer_bind 1..20: downstream amplification primer 99-2193 for SEQ 1206, in complement
cattcttttttgagagtacc

SEQ ID NO: 9072 - DNA, 21 bp, Homo Sapiens
  primer_bind 1..21: downstream amplification primer 99-22011 for SEQ 1207, in complement
gttttacctatcagacctaag

SEQ ID NO: 9073 - DNA, 21 bp, Homo Sapiens
  primer_bind 1..21: downstream amplification primer 99-22015 for SEQ 1208, in complement
gtgaaagaaatggattgtttg

SEQ ID NO: 9074 - DNA, 19 bp, Homo Sapiens
  primer_bind 1..19: downstream amplification primer 99-22022 for SEQ 1209, in complement
tgacaattaaaactcagcc

SEQ ID NO: 9075 - DNA, 18 bp, Homo Sapiens
  primer_bind 1..18: downstream amplification primer 99-22027 for SEQ 1210, in complement
atgcaagctcttttgacc

SEQ ID NO: 9076 - DNA, 21 bp, Homo Sapiens
  primer_bind 1..21: downstream amplification primer 99-22036 for SEQ 1211, in complement
tcctgctttgtttttggatag

SEQ ID NO: 9077 - DNA, 18 bp, Homo Sapiens
  primer_bind 1..18: downstream amplification primer 99-22038 for SEQ 1212, in complement
tcatccattgtgtctgtg

SEQ ID NO: 9078 - DNA, 19 bp, Homo Sapiens
  primer_bind 1..19: downstream amplification primer 99-22044 for SEQ 1213, in complement
catgtaaaattgtcagacc

SEQ ID NO: 9079 - DNA, 18 bp, Homo Sapiens
  primer_bind 1..18: downstream amplification primer 99-22048 for SEQ 1214, in complement
gctctagtgcttttcctg

SEQ ID NO: 9080 - DNA, 21 bp, Homo Sapiens
  primer_bind 1..21: downstream amplification primer 99-22051 for SEQ 1215, in complement
ctagtaactctggtacaaagg

SEQ ID NO: 9081 - DNA, 18 bp, Homo Sapiens
  primer_bind 1..18: downstream amplification primer 99-22066 for SEQ 1216, in complement
ttcttttatggggacagg

SEQ ID NO: 9082 - DNA, 18 bp, Homo Sapiens
  primer_bind 1..18: downstream amplification primer 99-22072 for SEQ 1217, in complement
ccttccatctcatctctc

SEQ ID NO: 9083 - DNA, 20 bp, Homo Sapiens
  primer_bind 1..20: downstream amplification primer 99-22073 for SEQ 1218, in complement
tgcacacacactgcttgctg

SEQ ID NO: 9084 - DNA, 21 bp, Homo Sapiens
  primer_bind 1..21: downstream amplification primer 99-22078 for SEQ 1219, in complement
cttaactattacgttctactg

SEQ ID NO: 9085 - DNA, 21 bp, Homo Sapiens
  primer_bind 1..21: downstream amplification primer 99-22087 for SEQ 1220, in complement
aaatgggaaacagaaacaatc

SEQ ID NO: 9086 - DNA, 21 bp, Homo Sapiens
  primer_bind 1..21: downstream amplification primer 99-2209 for SEQ 1221, in complement
aaagcagcaaattttggtagg

SEQ ID NO: 9087 - DNA, 20 bp, Homo Sapiens
  primer_bind 1..20: downstream amplification primer 99-22091 for SEQ 1222, in complement
gattggctgcactgtatttc

SEQ ID NO: 9088 - DNA, 19 bp, Homo Sapiens
  primer_bind 1..19: downstream amplification primer 99-22096 for SEQ 1223, in complement
gcagctttttttctttctc

SEQ ID NO: 9089 - DNA, 18 bp, Homo Sapiens
  primer_bind 1..18: downstream amplification primer 99-22100 for SEQ 1224, in complement
gcgggtactttataactg

SEQ ID NO: 9090 - DNA, 21 bp, Homo Sapiens
  primer_bind 1..21: downstream amplification primer 99-22102 for SEQ 1225, in complement
tggatatggaaggatgttaag

SEQ ID NO: 9091 - DNA, 21 bp, Homo Sapiens
  primer_bind 1..21: downstream amplification primer 99-22122 for SEQ 1226, in complement
agtgaaattggagagtgaatg

SEQ ID NO: 9092 - DNA, 20 bp, Homo Sapiens
  primer_bind 1..20: downstream amplification primer 99-22125 for SEQ 1227, in complement
cactgaatcttttttaggac

SEQ ID NO: 9093 - DNA, 18 bp, Homo Sapiens
  primer_bind 1..18: downstream amplification primer 99-2214 for SEQ 1228, in complement
atgggaaatgtctgggtg

SEQ ID NO: 9094 - DNA, 20 bp, Homo Sapiens
  primer_bind 1..20: downstream amplification primer 99-22147 for SEQ 1229, in complement
gaaaagcagttattagtagg

SEQ ID NO: 9095 - DNA, 21 bp, Homo Sapiens
  primer_bind 1..21: downstream amplification primer 99-22160 for SEQ 1230, in complement
tttgcttagaaacccactgag

SEQ ID NO: 9096 - DNA, 20 bp, Homo Sapiens
  primer_bind 1..20: downstream amplification primer 99-22167 for SEQ 1231, in complement
aatcccctctttccccacac

SEQ ID NO: 9097 - DNA, 19 bp, Homo Sapiens
  primer_bind 1..19: downstream amplification primer 99-22172 for SEQ 1232, in complement
atctgacagattactcttc

SEQ ID NO: 9098 - DNA, 21 bp, Homo Sapiens
  primer_bind 1..21: downstream amplification primer 99-2218 for SEQ 1233, in complement
cacttttcaaaatgttgacac

SEQ ID NO: 9099 - DNA, 19 bp, Homo Sapiens
  primer_bind 1..19: downstream amplification primer 99-22189 for SEQ 1234, in complement
tcgtctacctactttaatg

SEQ ID NO: 9100 - DNA, 21 bp, Homo Sapiens
  primer_bind 1..21: downstream amplification primer 99-2219 for SEQ 1235, in complement
agagagggaagacaaatgagg

SEQ ID NO: 9101 - DNA, 20 bp, Homo Sapiens
  primer_bind 1..20: downstream amplification primer 99-22191 for SEQ 1236, in complement
aagggatggcatagcgtgag

SEQ ID NO: 9102 - DNA, 21 bp, Homo Sapiens
  primer_bind 1..21: downstream amplification primer 99-22192 for SEQ 1237, in complement
cacctaacattcagttttctc

SEQ ID NO: 9103 - DNA, 21 bp, Homo Sapiens
  primer_bind 1..21: downstream amplification primer 99-222 for SEQ 1238, in complement
gaaacagactgaagcaaggac

SEQ ID NO: 9104 - DNA, 21 bp, Homo Sapiens
  primer_bind 1..21: downstream amplification primer 99-2220 for SEQ 1239, in complement
cttgcatctttgtttatgagg

SEQ ID NO: 9105 - DNA, 20 bp, Homo Sapiens
  primer_bind 1..20: downstream amplification primer 99-22209 for SEQ 1240, in complement
ggggtaattcaaaaagtctg

SEQ ID NO: 9106 - DNA, 21 bp, Homo Sapiens
  primer_bind 1..21: downstream amplification primer 99-22215 for SEQ 1241, in complement
cacaaaattgctagaagagag

SEQ ID NO: 9107 - DNA, 21 bp, Homo Sapiens
  primer_bind 1..21: downstream amplification primer 99-22217 for SEQ 1242, in complement
taccagctatgcgactttgcc

SEQ ID NO: 9108 - DNA, 19 bp, Homo Sapiens
  primer_bind 1..19: downstream amplification primer 99-2222 for SEQ 1243, in complement
agggagggaaccatgtaag

SEQ ID NO: 9109 - DNA, 21 bp, Homo Sapiens
  primer_bind 1..21: downstream amplification primer 99-22227 for SEQ 1244, in complement
atgatttgtgtgagttaagcc

SEQ ID NO: 9110 - DNA, 20 bp, Homo Sapiens
  primer_bind 1..20: downstream amplification primer 99-22255 for SEQ 1245, in complement
gattgtaatgagaaaagccc

SEQ ID NO: 9111 - DNA, 18 bp, Homo Sapiens
  primer_bind 1..18: downstream amplification primer 99-22262 for SEQ 1246, in complement
attttcctctggctgttc

SEQ ID NO: 9112 - DNA, 21 bp, Homo Sapiens
  primer_bind 1..21: downstream amplification primer 99-22265 for SEQ 1247, in complement
ttgagccagtctttgtcatag

SEQ ID NO: 9113 - DNA, 19 bp, Homo Sapiens
  primer_bind 1..19: downstream amplification primer 99-22266 for SEQ 1248, in complement
aggtttgagaaaaagttgg

SEQ ID NO: 9114 - DNA, 18 bp, Homo Sapiens
  primer_bind 1..18: downstream amplification primer 99-2228 for SEQ 1249, in complement
caaaacactccctcacac

SEQ ID NO: 9115 - DNA, 18 bp, Homo Sapiens
  primer_bind 1..18: downstream amplification primer 99-2229 for SEQ 1250, in complement
caggtgatgtctggatac

SEQ ID NO: 9116 - DNA, 21 bp, Homo Sapiens
  primer_bind 1..21: downstream amplification primer 99-22333 for SEQ 1251, in complement
gaaaagtgctatgaaagaaac

SEQ ID NO: 9117 - DNA, 20 bp, Homo Sapiens
  primer_bind 1..20: downstream amplification primer 99-22336 for SEQ 1252, in complement
cagaacacctttgcttttcc

SEQ ID NO: 9118 - DNA, 21 bp, Homo Sapiens
  primer_bind 1..21: downstream amplification primer 99-22337 for SEQ 1253, in complement
ttccatcaaaacatacttctc

SEQ ID NO: 9119 - DNA, 21 bp, Homo Sapiens
  primer_bind 1..21: downstream amplification primer 99-2235 for SEQ 1254, in complement
gcctatgttgcagcatacatc

SEQ ID NO: 9120 - DNA, 19 bp, Homo Sapiens
  primer_bind 1..19: downstream amplification primer 99-22356 for SEQ 1255, in complement
agtgttggggaggatgaag

SEQ ID NO: 9121 - DNA, 19 bp, Homo Sapiens
  primer_bind 1..19: downstream amplification primer 99-22357 for SEQ 1256, in complement
atggggtcttcacagtcag

SEQ ID NO: 9122 - DNA, 21 bp, Homo Sapiens
  primer_bind 1..21: downstream amplification primer 99-2240 for SEQ 1257, in complement
aagacaacaagaactaaatcc

SEQ ID NO: 9123 - DNA, 21 bp, Homo Sapiens
  primer_bind 1..21: downstream amplification primer 99-22409 for SEQ 1258, in complement
ttggaacattacttgcctgac

SEQ ID NO: 9124 - DNA, 20 bp, Homo Sapiens
  primer_bind 1..20: downstream amplification primer 99-2242 for SEQ 1259, in complement
tccccaatagattaaagttc

SEQ ID NO: 9125 - DNA, 18 bp, Homo Sapiens
  primer_bind 1..18: downstream amplification primer 99-2244 for SEQ 1260, in complement
ctgagcatcaaataggag

SEQ ID NO: 9126 - DNA, 18 bp, Homo Sapiens
  primer_bind 1..18: downstream amplification primer 99-22442 for SEQ 1261, in complement
tttgggagagaagagaag

SEQ ID NO: 9127 - DNA, 19 bp, Homo Sapiens
  primer_bind 1..19: downstream amplification primer 99-22449 for SEQ 1262, in complement
agaaaaacttcagttccag

SEQ ID NO: 9128 - DNA, 19 bp, Homo Sapiens
  primer_bind 1..19: downstream amplification primer 99-22453 for SEQ 1263, in complement
gaggagcagtgttacatag

SEQ ID NO: 9129 - DNA, 20 bp, Homo Sapiens
  primer_bind 1..20: downstream amplification primer 99-22456 for SEQ 1264, in complement
catgggactactgtgaggtg

SEQ ID NO: 9130 - DNA, 21 bp, Homo Sapiens
  primer_bind 1..21: downstream amplification primer 99-2246 for SEQ 1265, in complement
tcattacagaaaaagccaaag

SEQ ID NO: 9131 - DNA, 20 bp, Homo Sapiens
  primer_bind 1..20: downstream amplification primer 99-2248 for SEQ 1266, in complement
tccttctccacctaaaattc

SEQ ID NO: 9132 - DNA, 19 bp, Homo Sapiens
  primer_bind 1..19: downstream amplification primer 99-22490 for SEQ 1267, in complement
aaaggggctggctaatgtc

SEQ ID NO: 9133 - DNA, 18 bp, Homo Sapiens
  primer_bind 1..18: downstream amplification primer 99-22491 for SEQ 1268, in complement
ggagactttagtatcagg

SEQ ID NO: 9134 - DNA, 18 bp, Homo Sapiens
  primer_bind 1..18: downstream amplification primer 99-2250 for SEQ 1269, in complement
actgcttctgctctcttg

SEQ ID NO: 9135 - DNA, 18 bp, Homo Sapiens
  primer_bind 1..18: downstream amplification primer 99-22503 for SEQ 1270, in complement
atcagtccacctgttacc

SEQ ID NO: 9136 - DNA, 19 bp, Homo Sapiens
  primer_bind 1..19: downstream amplification primer 99-22506 for SEQ 1271, in complement
caagggcaaagtgagtagg

SEQ ID NO: 9137 - DNA, 21 bp, Homo Sapiens
  primer_bind 1..21: downstream amplification primer 99-22513 for SEQ 1272, in complement
gtgaaataaatgttccttctc

SEQ ID NO: 9138 - DNA, 21 bp, Homo Sapiens
  primer_bind 1..21: downstream amplification primer 99-22520 for SEQ 1273, in complement
actcacaaacctttacttctc

SEQ ID NO: 9139 - DNA, 19 bp, Homo Sapiens
  primer_bind 1..19: downstream amplification primer 99-22546 for SEQ 1274, in complement
aatcaggctcaaacggtgg

SEQ ID NO: 9140 - DNA, 21 bp, Homo Sapiens
  primer_bind 1..21: downstream amplification primer 99-22565 for SEQ 1275, in complement
gacgaagagtttacagaatag

SEQ ID NO: 9141 - DNA, 19 bp, Homo Sapiens
  primer_bind 1..19: downstream amplification primer 99-22571 for SEQ 1276, in complement
gctctcatccacaataatc

SEQ ID NO: 9142 - DNA, 19 bp, Homo Sapiens
  primer_bind 1..19: downstream amplification primer 99-22573 for SEQ 1277, in complement
cattcagtgctttgctgtc

SEQ ID NO: 9143 - DNA, 21 bp, Homo Sapiens
  primer_bind 1..21: downstream amplification primer 99-22578 for SEQ 1278, in complement
agacttgaccttatctgagac

SEQ ID NO: 9144 - DNA, 19 bp, Homo Sapiens
  primer_bind 1..19: downstream amplification primer 99-22580 for SEQ 1279, in complement
ctattagaaggcttgaaac

SEQ ID NO: 9145 - DNA, 21 bp, Homo Sapiens
  primer_bind 1..21: downstream amplification primer 99-22585 for SEQ 1280, in complement
acttcatttttccaccaaacc

SEQ ID NO: 9146 - DNA, 20 bp, Homo Sapiens
  primer_bind 1..20: downstream amplification primer 99-22586 for SEQ 1281, in complement
cactaacacttcccaaatcc

SEQ ID NO: 9147 - DNA, 20 bp, Homo Sapiens
  primer_bind 1..20: downstream amplification primer 99-22604 for SEQ 1282, in complement
ttttaggatcgttacagcag

SEQ ID NO: 9148 - DNA, 19 bp, Homo Sapiens
  primer_bind 1..19: downstream amplification primer 99-22610 for SEQ 1283, in complement
cactctgccacacagtatg

SEQ ID NO: 9149 - DNA, 19 bp, Homo Sapiens
  primer_bind 1..19: downstream amplification primer 99-22615 for SEQ 1284, in complement
tagggggagaaagtgtgtg

SEQ ID NO: 9150 - DNA, 21 bp, Homo Sapiens
  primer_bind 1..21: downstream amplification primer 99-22617 for SEQ 1285, in complement
ttctgttattctgcgtgtttc

SEQ ID NO: 9151 - DNA, 18 bp, Homo Sapiens
  primer_bind 1..18: downstream amplification primer 99-22620 for SEQ 1286, in complement
gccaacaaaccatgatag

SEQ ID NO: 9152 - DNA, 19 bp, Homo Sapiens
  primer_bind 1..19: downstream amplification primer 99-22628 for SEQ 1287, in complement
tggagcaggtcacaactac

SEQ ID NO: 9153 - DNA, 19 bp, Homo Sapiens
  primer_bind 1..19: downstream amplification primer 99-22629 for SEQ 1288, in complement
tggaaagccttagtatttg

SEQ ID NO: 9154 - DNA, 21 bp, Homo Sapiens
  primer_bind 1..21: downstream amplification primer 99-22632 for SEQ 1289, in complement
cctgctctcgaaaatgacaac

SEQ ID NO: 9155 - DNA, 21 bp, Homo Sapiens
  primer_bind 1..21: downstream amplification primer 99-22646 for SEQ 1290, in complement
ataagtgagaactcccctccc

SEQ ID NO: 9156 - DNA, 18 bp, Homo Sapiens
  primer_bind 1..18: downstream amplification primer 99-22648 for SEQ 1291, in complement
aaaaaaagtgggaggggg

SEQ ID NO: 9157 - DNA, 19 bp, Homo Sapiens
  primer_bind 1..19: downstream amplification primer 99-22650 for SEQ 1292, in complement
aaaggtgtgcatccaaatg

SEQ ID NO: 9158 - DNA, 21 bp, Homo Sapiens
  primer_bind 1..21: downstream amplification primer 99-22652 for SEQ 1293, in complement
ctgccaggtagactcagtatg

SEQ ID NO: 9159 - DNA, 18 bp, Homo Sapiens
  primer_bind 1..18: downstream amplification primer 99-22655 for SEQ 1294, in complement
gtcagcaaaggtggtatc

SEQ ID NO: 9160 - DNA, 19 bp, Homo Sapiens
  primer_bind 1..19: downstream amplification primer 99-22660 for SEQ 1295, in complement
ccttatccctcttctattc

SEQ ID NO: 9161 - DNA, 21 bp, Homo Sapiens
  primer_bind 1..21: downstream amplification primer 99-22662 for SEQ 1296, in complement
gctcttggataaataatcaac

SEQ ID NO: 9162 - DNA, 21 bp, Homo Sapiens
  primer_bind 1..21: downstream amplification primer 99-22666 for SEQ 1297, in complement
catttacagtggagcaaaatc

SEQ ID NO: 9163 - DNA, 20 bp, Homo Sapiens
  primer_bind 1..20: downstream amplification primer 99-22668 for SEQ 1298, in complement
tgcattgaagtgctatatcc

SEQ ID NO: 9164 - DNA, 19 bp, Homo Sapiens
  primer_bind 1..19: downstream amplification primer 99-22674 for SEQ 1299, in complement
tcactccacattttctatg

SEQ ID NO: 9165 - DNA, 21 bp, Homo Sapiens
  primer_bind 1..21: downstream amplification primer 99-22675 for SEQ 1300, in complement
agtagaaaggcattaaattgg

SEQ ID NO: 9166 - DNA, 19 bp, Homo Sapiens
  primer_bind 1..19: downstream amplification primer 99-22680 for SEQ 1301, in complement
gaacttcggtgtgagaaac

SEQ ID NO: 9167 - DNA, 21 bp, Homo Sapiens
  primer_bind 1..21: downstream amplification primer 99-22683 for SEQ 1302, in complement
gagatagaaagtggagacagg

SEQ ID NO: 9168 - DNA, 18 bp, Homo Sapiens
  primer_bind 1..18: downstream amplification primer 99-2269 for SEQ 1303, in complement
agagttgttggcatgtag

SEQ ID NO: 9169 - DNA, 21 bp, Homo Sapiens
  primer_bind 1..21: downstream amplification primer 99-22700 for SEQ 1304, in complement
atcgcctgctcttgttatttg

SEQ ID NO: 9170 - DNA, 19 bp, Homo Sapiens
  primer_bind 1..19: downstream amplification primer 99-22701 for SEQ 1305, in complement
caacacaagtaaagcacag

SEQ ID NO: 9171 - DNA, 18 bp, Homo Sapiens
  primer_bind 1..18: downstream amplification primer 99-2271 for SEQ 1306, in complement
aactgctcagcaactgtg

SEQ ID NO: 9172 - DNA, 21 bp, Homo Sapiens
  primer_bind 1..21: downstream amplification primer 99-22712 for SEQ 1307, in complement
attcagatattcaagcaaccc

SEQ ID NO: 9173 - DNA, 21 bp, Homo Sapiens
  primer_bind 1..21: downstream amplification primer 99-22718 for SEQ 1308, in complement
gagggtaaatgagcttttgcc

SEQ ID NO: 9174 - DNA, 21 bp, Homo Sapiens
  primer_bind 1..21: downstream amplification primer 99-2272 for SEQ 1309, in complement
ttagaacacttttatgggaac

SEQ ID NO: 9175 - DNA, 21 bp, Homo Sapiens
  primer_bind 1..21: downstream amplification primer 99-22728 for SEQ 1310, in complement
atttatggaaggctctaaaac

SEQ ID NO: 9176 - DNA, 19 bp, Homo Sapiens
  primer_bind 1..19: downstream amplification primer 99-2273 for SEQ 1311, in complement
gtcctagaatgagcaaatg

SEQ ID NO: 9177 - DNA, 21 bp, Homo Sapiens
  primer_bind 1..21: downstream amplification primer 99-22733 for SEQ 1312, in complement
gttttatgatagaagatgtcc

SEQ ID NO: 9178 - DNA, 21 bp, Homo Sapiens
  primer_bind 1..21: downstream amplification primer 99-22741 for SEQ 1313, in complement
tattttattgggttttagggc

SEQ ID NO: 9179 - DNA, 18 bp, Homo Sapiens
  primer_bind 1..18: downstream amplification primer 99-2275 for SEQ 1314, in complement
agagaaagaaccagagcc

SEQ ID NO: 9180 - DNA, 21 bp, Homo Sapiens
  primer_bind 1..21: downstream amplification primer 99-2276 for SEQ 1315, in complement
tgaaaacaaaacacaagggac

SEQ ID NO: 9181 - DNA, 18 bp, Homo Sapiens
  primer_bind 1..18: downstream amplification primer 99-22771 for SEQ 1316, in complement
ctaactcagctccatttg

SEQ ID NO: 9182 - DNA, 18 bp, Homo Sapiens
  primer_bind 1..18: downstream amplification primer 99-22775 for SEQ 1317, in complement
actcgcaatgcaagaaac

SEQ ID NO: 9183 - DNA, 18 bp, Homo Sapiens
  primer_bind 1..18: downstream amplification primer 99-2278 for SEQ 1318, in complement
tggagtctaaactaggtg

SEQ ID NO: 9184 - DNA, 19 bp, Homo Sapiens
  primer_bind 1..19: downstream amplification primer 99-22785 for SEQ 1319, in complement
catcatccctgttttatag

SEQ ID NO: 9185 - DNA, 21 bp, Homo Sapiens
  primer_bind 1..21: downstream amplification primer 99-22843 for SEQ 1320, in complement
tgcacaagagcaagtgatgcc

SEQ ID NO: 9186 - DNA, 19 bp, Homo Sapiens
  primer_bind 1..19: downstream amplification primer 99-22844 for SEQ 1321, in complement
gtatataggtagatggtag

SEQ ID NO: 9187 - DNA, 21 bp, Homo Sapiens
  primer_bind 1..21: downstream amplification primer 99-22857 for SEQ 1322, in complement
ggattttttttctctgctctg

SEQ ID NO: 9188 - DNA, 18 bp, Homo Sapiens
  primer_bind 1..18: downstream amplification primer 99-22868 for SEQ 1323, in complement
atatgatggtgagaggag

SEQ ID NO: 9189 - DNA, 18 bp, Homo Sapiens
  primer_bind 1..18: downstream amplification primer 99-22872 for SEQ 1324, in complement
ccattagtgggaagaaag

SEQ ID NO: 9190 - DNA, 21 bp, Homo Sapiens
  primer_bind 1..21: downstream amplification primer 99-2288 for SEQ 1325, in complement
aactttaaatgtgtcagcttg

SEQ ID NO: 9191 - DNA, 19 bp, Homo Sapiens
  primer_bind 1..19: downstream amplification primer 99-22917 for SEQ 1326, in complement
aaggggtcaacggaagtag

SEQ ID NO: 9192 - DNA, 19 bp, Homo Sapiens
  primer_bind 1..19: downstream amplification primer 99-22937 for SEQ 1327, in complement
tctcatgttttctatggac

SEQ ID NO: 9193 - DNA, 19 bp, Homo Sapiens
  primer_bind 1..19: downstream amplification primer 99-22948 for SEQ 1328, in complement
tctcaaatcattctgatgg

SEQ ID NO: 9194 - DNA, 18 bp, Homo Sapiens
  primer_bind 1..18: downstream amplification primer 99-22954 for SEQ 1329, in complement
ctaggtaagacataccag

SEQ ID NO: 9195 - DNA, 21 bp, Homo Sapiens
  primer_bind 1..21: downstream amplification primer 99-22957 for SEQ 1330, in complement
catctatactgcttctctgtc

SEQ ID NO: 9196 - DNA, 19 bp, Homo Sapiens
  primer_bind 1..19: downstream amplification primer 99-22959 for SEQ 1331, in complement
caatagacgttaaggtaag

SEQ ID NO: 9197 - DNA, 20 bp, Homo Sapiens
  primer_bind 1..20: downstream amplification primer 99-22964 for SEQ 1332, in complement
gccctcacatagcttctttc

SEQ ID NO: 9198 - DNA, 20 bp, Homo Sapiens
  primer_bind 1..20: downstream amplification primer 99-22975 for SEQ 1333, in complement
ctctgttaaatctattcgcc

SEQ ID NO: 9199 - DNA, 18 bp, Homo Sapiens
  primer_bind 1..18: downstream amplification primer 99-23014 for SEQ 1334, in complement
ataaaggctgctttctgg

SEQ ID NO: 9200 - DNA, 19 bp, Homo Sapiens
  primer_bind 1..19: downstream amplification primer 99-23018 for SEQ 1335, in complement
acttaggctgggtttctgg

SEQ ID NO: 9201 - DNA, 21 bp, Homo Sapiens
  primer_bind 1..21: downstream amplification primer 99-23020 for SEQ 1336, in complement
tgattttgcttttctctgccc

SEQ ID NO: 9202 - DNA, 18 bp, Homo Sapiens
  primer_bind 1..18: downstream amplification primer 99-23083 for SEQ 1337, in complement
tggttcagttggcatatc

SEQ ID NO: 9203 - DNA, 18 bp, Homo Sapiens
  primer_bind 1..18: downstream amplification primer 99-23100 for SEQ 1338, in complement
ctgatttctgggagaagg

SEQ ID NO: 9204 - DNA, 19 bp, Homo Sapiens
  primer_bind 1..19: downstream amplification primer 99-23115 for SEQ 1339, in complement
gttaaattcctcactccag

SEQ ID NO: 9205 - DNA, 18 bp, Homo Sapiens
  primer_bind 1..18: downstream amplification primer 99-23118 for SEQ 1340, in complement
catccctgtttttctgtg

SEQ ID NO: 9206 - DNA, 18 bp, Homo Sapiens
  primer_bind 1..18: downstream amplification primer 99-2312 for SEQ 1341, in complement
ggaccttttaagagtgtg

SEQ ID NO: 9207 - DNA, 20 bp, Homo Sapiens
  primer_bind 1..20: downstream amplification primer 99-23123 for SEQ 1342, in complement
gactgaaatgctaatagcac

SEQ ID NO: 9208 - DNA, 19 bp, Homo Sapiens
  primer_bind 1..19: downstream amplification primer 99-23127 for SEQ 1343, in complement
gatatggacccaaagtaag

SEQ ID NO: 9209 - DNA, 18 bp, Homo Sapiens
  primer_bind 1..18: downstream amplification primer 99-23132 for SEQ 1344, in complement
ctttgctgccaagactac

SEQ ID NO: 9210 - DNA, 20 bp, Homo Sapiens
  primer_bind 1..20: downstream amplification primer 99-23134 for SEQ 1345, in complement
gaatgtgtgcttgtttttgg

SEQ ID NO: 9211 - DNA, 19 bp, Homo Sapiens
  primer_bind 1..19: downstream amplification primer 99-2315 for SEQ 1346, in complement
tggtttcttcaaacaagag

SEQ ID NO: 9212 - DNA, 20 bp, Homo Sapiens
  primer_bind 1..20: downstream amplification primer 99-23150 for SEQ 1347, in complement
agatacccacccttctctcc

SEQ ID NO: 9213 - DNA, 21 bp, Homo Sapiens
  primer_bind 1..21: downstream amplification primer 99-2320 for SEQ 1348, in complement
aagttggataaccttcttttg

SEQ ID NO: 9214 - DNA, 21 bp, Homo Sapiens
  primer_bind 1..21: downstream amplification primer 99-23201 for SEQ 1349, in complement
tagacacagacacacaacaac

SEQ ID NO: 9215 - DNA, 21 bp, Homo Sapiens
  primer_bind 1..21: downstream amplification primer 99-23202 for SEQ 1350, in complement
cttcacataaccttctttttc

SEQ ID NO: 9216 - DNA, 19 bp, Homo Sapiens
  primer_bind 1..19: downstream amplification primer 99-23204 for SEQ 1351, in complement
ttcttacttctcctcctgc

SEQ ID NO: 9217 - DNA, 21 bp, Homo Sapiens
  primer_bind 1..21: downstream amplification primer 99-23207 for SEQ 1352, in complement
cttcatctcaaccacatacac

SEQ ID NO: 9218 - DNA, 19 bp, Homo Sapiens
  primer_bind 1..19: downstream amplification primer 99-2321 for SEQ 1353, in complement
tagtttcgtgaacttatcc

SEQ ID NO: 9219 - DNA, 19 bp, Homo Sapiens
  primer_bind 1..19: downstream amplification primer 99-23228 for SEQ 1354, in complement
gtggaataaagtagtgtag

SEQ ID NO: 9220 - DNA, 21 bp, Homo Sapiens
  primer_bind 1..21: downstream amplification primer 99-2324 for SEQ 1355, in complement
gtttacattatgccccttttc

SEQ ID NO: 9221 - DNA, 19 bp, Homo Sapiens
  primer_bind 1..19: downstream amplification primer 99-23266 for SEQ 1356, in complement
gaaaacctaacatacagcc

SEQ ID NO: 9222 - DNA, 18 bp, Homo Sapiens
  primer_bind 1..18: downstream amplification primer 99-23269 for SEQ 1357, in complement
gtacttagcacaagctcc

SEQ ID NO: 9223 - DNA, 21 bp, Homo Sapiens
  primer_bind 1..21: downstream amplification primer 99-2328 for SEQ 1358, in complement
aactaatactaattttggggg

SEQ ID NO: 9224 - DNA, 18 bp, Homo Sapiens
  primer_bind 1..18: downstream amplification primer 99-23299 for SEQ 1359, in complement
caagatttgctggtaggg

SEQ ID NO: 9225 - DNA, 20 bp, Homo Sapiens
  primer_bind 1..20: downstream amplification primer 99-23302 for SEQ 1360, in complement
tggggaattgacacaagtag

SEQ ID NO: 9226 - DNA, 19 bp, Homo Sapiens
  primer_bind 1..19: downstream amplification primer 99-2331 for SEQ 1361, in complement
gattcaagtatatcgtgcc

SEQ ID NO: 9227 - DNA, 18 bp, Homo Sapiens
  primer_bind 1..18: downstream amplification primer 99-23312 for SEQ 1362, in complement
ttagcatactggagcagg

SEQ ID NO: 9228 - DNA, 18 bp, Homo Sapiens
  primer_bind 1..18: downstream amplification primer 99-23317 for SEQ 1363, in complement
atccccaagttcaaatcc

SEQ ID NO: 9229 - DNA, 21 bp, Homo Sapiens
  primer_bind 1..21: downstream amplification primer 99-23322 for SEQ 1364, in complement
gaataaatgaaccagtgtccc

SEQ ID NO: 9230 - DNA, 21 bp, Homo Sapiens
  primer_bind 1..21: downstream amplification primer 99-23326 for SEQ 1365, in complement
tcacatttgcaggcttcatgg

SEQ ID NO: 9231 - DNA, 18 bp, Homo Sapiens
  primer_bind 1..18: downstream amplification primer 99-23328 for SEQ 1366, in complement
tctcttcccagtaacctc

SEQ ID NO: 9232 - DNA, 19 bp, Homo Sapiens
  primer_bind 1..19: downstream amplification primer 99-23333 for SEQ 1367, in complement
gcttactgaattatcactg

SEQ ID NO: 9233 - DNA, 18 bp, Homo Sapiens
  primer_bind 1..18: downstream amplification primer 99-23334 for SEQ 1368, in complement
aagcactgaagctggaac

SEQ ID NO: 9234 - DNA, 18 bp, Homo Sapiens
  primer_bind 1..18: downstream amplification primer 99-23359 for SEQ 1369, in complement
ttcctgcttcctaatgtg

SEQ ID NO: 9235 - DNA, 20 bp, Homo Sapiens
  primer_bind 1..20: downstream amplification primer 99-23381 for SEQ 1370, in complement
gacattttatttggggaagg

SEQ ID NO: 9236 - DNA, 18 bp, Homo Sapiens
  primer_bind 1..18: downstream amplification primer 99-23387 for SEQ 1371, in complement
cttctttgggttttgggg

SEQ ID NO: 9237 - DNA, 18 bp, Homo Sapiens
  primer_bind 1..18: downstream amplification primer 99-23413 for SEQ 1372, in complement
gggatagcaggtttcaag

SEQ ID NO: 9238 - DNA, 19 bp, Homo Sapiens
  primer_bind 1..19: downstream amplification primer 99-23415 for SEQ 1373, in complement
caataatgatggctgaagg

SEQ ID NO: 9239 - DNA, 21 bp, Homo Sapiens
  primer_bind 1..21: downstream amplification primer 99-23417 for SEQ 1374, in complement
tggtcgctctctttagagatg

SEQ ID NO: 9240 - DNA, 20 bp, Homo Sapiens
  primer_bind 1..20: downstream amplification primer 99-23437 for SEQ 1375, in complement
gcatgtgtttaacatttacc

SEQ ID NO: 9241 - DNA, 21 bp, Homo Sapiens
  primer_bind 1..21: downstream amplification primer 99-23440 for SEQ 1376, in complement
atttcgagtgggatgaagttg

SEQ ID NO: 9242 - DNA, 21 bp, Homo Sapiens
  primer_bind 1..21: downstream amplification primer 99-23444 for SEQ 1377, in complement
tgtattggcatacaacccttg

SEQ ID NO: 9243 - DNA, 21 bp, Homo Sapiens
  primer_bind 1..21: downstream amplification primer 99-2345 for SEQ 1378, in complement
tctgatgtaaaatacactgcc

SEQ ID NO: 9244 - DNA, 19 bp, Homo Sapiens
  primer_bind 1..19: downstream amplification primer 99-23451 for SEQ 1379, in complement
tctacttcttggaactcac

SEQ ID NO: 9245 - DNA, 21 bp, Homo Sapiens
  primer_bind 1..21: downstream amplification primer 99-23452 for SEQ 1380, in complement
gccctgacaatgtagtcaaag

SEQ ID NO: 9246 - DNA, 21 bp, Homo Sapiens
  primer_bind 1..21: downstream amplification primer 99-23454 for SEQ 1381, in complement
ctaggtctaaagtaggctgtg

SEQ ID NO: 9247 - DNA, 21 bp, Homo Sapiens
  primer_bind 1..21: downstream amplification primer 99-23460 for SEQ 1382, in complement
caatatacttcccccagagtg

SEQ ID NO: 9248 - DNA, 18 bp, Homo Sapiens
  primer_bind 1..18: downstream amplification primer 99-23462 for SEQ 1383, in complement
caggttcaattcagcatc

SEQ ID NO: 9249 - DNA, 20 bp, Homo Sapiens
  primer_bind 1..20: downstream amplification primer 99-23463 for SEQ 1384, in complement
ttggaaaaagcagtggtctc

SEQ ID NO: 9250 - DNA, 21 bp, Homo Sapiens
  primer_bind 1..21: downstream amplification primer 99-23469 for SEQ 1385, in complement
cttcttttatcccctttctcc

SEQ ID NO: 9251 - DNA, 21 bp, Homo Sapiens
  primer_bind 1..21: downstream amplification primer 99-2347 for SEQ 1386, in complement
tgatgaccagcataattggag

SEQ ID NO: 9252 - DNA, 18 bp, Homo Sapiens
  primer_bind 1..18: downstream amplification primer 99-23473 for SEQ 1387, in complement
aggagtggtagaatgaac

SEQ ID NO: 9253 - DNA, 21 bp, Homo Sapiens
  primer_bind 1..21: downstream amplification primer 99-2348 for SEQ 1388, in complement
ttaatctttccaggaagccag

SEQ ID NO: 9254 - DNA, 21 bp, Homo Sapiens
  primer_bind 1..21: downstream amplification primer 99-23488 for SEQ 1389, in complement
aatggagtctattcaaagagg

SEQ ID NO: 9255 - DNA, 21 bp, Homo Sapiens
  primer_bind 1..21: downstream amplification primer 99-23492 for SEQ 1390, in complement
ttttagtgtagtaatgggagg

SEQ ID NO: 9256 - DNA, 21 bp, Homo Sapiens
  primer_bind 1..21: downstream amplification primer 99-23496 for SEQ 1391, in complement
gtgaattaatgggaaagtttg

SEQ ID NO: 9257 - DNA, 21 bp, Homo Sapiens
  primer_bind 1..21: downstream amplification primer 99-23510 for SEQ 1392, in complement
ttaaatgaaattgcacagagg

SEQ ID NO: 9258 - DNA, 18 bp, Homo Sapiens
  primer_bind 1..18: downstream amplification primer 99-23528 for SEQ 1393, in complement
ttaacccagccattctcc

SEQ ID NO: 9259 - DNA, 20 bp, Homo Sapiens
  primer_bind 1..20: downstream amplification primer 99-2356 for SEQ 1394, in complement
cattcagttcggtgctttgg

SEQ ID NO: 9260 - DNA, 18 bp, Homo Sapiens
  primer_bind 1..18: downstream amplification primer 99-2362 for SEQ 1395, in complement
atgaagatacgcagccag

SEQ ID NO: 9261 - DNA, 21 bp, Homo Sapiens
  primer_bind 1..21: downstream amplification primer 99-2364 for SEQ 1396, in complement
ctcatttaactcccattcctc

SEQ ID NO: 9262 - DNA, 21 bp, Homo Sapiens
  primer_bind 1..21: downstream amplification primer 99-2367 for SEQ 1397, in complement
tgcttttcttgtccctgattg

SEQ ID NO: 9263 - DNA, 18 bp, Homo Sapiens
  primer_bind 1..18: downstream amplification primer 99-2368 for SEQ 1398, in complement
tattggaggcagaatcag

SEQ ID NO: 9264 - DNA, 19 bp, Homo Sapiens
  primer_bind 1..19: downstream amplification primer 99-23687 for SEQ 1399, in complement
accaatttgcttgtttacc

SEQ ID NO: 9265 - DNA, 18 bp, Homo Sapiens
  primer_bind 1..18: downstream amplification primer 99-237 for SEQ 1400, in complement
tcatgccaactccataac

SEQ ID NO: 9266 - DNA, 18 bp, Homo Sapiens
  primer_bind 1..18: downstream amplification primer 99-23714 for SEQ 1401, in complement
agttacccaccctttctc

SEQ ID NO: 9267 - DNA, 18 bp, Homo Sapiens
  primer_bind 1..18: downstream amplification primer 99-23737 for SEQ 1402, in complement
gaactgtgtcctcagaac

SEQ ID NO: 9268 - DNA, 18 bp, Homo Sapiens
  primer_bind 1..18: downstream amplification primer 99-2375 for SEQ 1403, in complement
tttttctcactgcggaac

SEQ ID NO: 9269 - DNA, 20 bp, Homo Sapiens
  primer_bind 1..20: downstream amplification primer 99-23773 for SEQ 1404, in complement
tgccgatgatggcgtagatg

SEQ ID NO: 9270 - DNA, 21 bp, Homo Sapiens
  primer_bind 1..21: downstream amplification primer 99-2378 for SEQ 1405, in complement
cagttttggtcattgtgggag

SEQ ID NO: 9271 - DNA, 21 bp, Homo Sapiens
  primer_bind 1..21: downstream amplification primer 99-2381 for SEQ 1406, in complement
aaatccaactatgtcacttcc

SEQ ID NO: 9272 - DNA, 21 bp, Homo Sapiens
  primer_bind 1..21: downstream amplification primer 99-2409 for SEQ 1407, in complement
tttttcccaacctcctctaac

SEQ ID NO: 9273 - DNA, 21 bp, Homo Sapiens
  primer_bind 1..21: downstream amplification primer 99-241 for SEQ 1408, in complement
gttttctgattttcctgaacc

SEQ ID NO: 9274 - DNA, 19 bp, Homo Sapiens
  primer_bind 1..19: downstream amplification primer 99-2413 for SEQ 1409, in complement
aatgtcccctcctcctctg

SEQ ID NO: 9275 - DNA, 19 bp, Homo Sapiens
  primer_bind 1..19: downstream amplification primer 99-2417 for SEQ 1410, in complement
gattcccttattgtctgtc

SEQ ID NO: 9276 - DNA, 20 bp, Homo Sapiens
  primer_bind 1..20: downstream amplification primer 99-2419 for SEQ 1411, in complement
gccacaagtatttgggtgcc

SEQ ID NO: 9277 - DNA, 19 bp, Homo Sapiens
  primer_bind 1..19: downstream amplification primer 99-24246 for SEQ 1412, in complement
caaaggaacacccaatatg

SEQ ID NO: 9278 - DNA, 19 bp, Homo Sapiens
  primer_bind 1..19: downstream amplification primer 99-24253 for SEQ 1413, in complement
tatagtcctctgctctacc

SEQ ID NO: 9279 - DNA, 20 bp, Homo Sapiens
  primer_bind 1..20: downstream amplification primer 99-24259 for SEQ 1414, in complement
ctaagtgatgtaataatggg

SEQ ID NO: 9280 - DNA, 21 bp, Homo Sapiens
  primer_bind 1..21: downstream amplification primer 99-24264 for SEQ 1415, in complement
ctgtggtggttccttgaaatg

SEQ ID NO: 9281 - DNA, 21 bp, Homo Sapiens
  primer_bind 1..21: downstream amplification primer 99-24269 for SEQ 1416, in complement
attcttccacctataattctc

SEQ ID NO: 9282 - DNA, 18 bp, Homo Sapiens
  primer_bind 1..18: downstream amplification primer 99-24270 for SEQ 1417, in complement
tgtttgtggatggaggag

SEQ ID NO: 9283 - DNA, 18 bp, Homo Sapiens
  primer_bind 1..18: downstream amplification primer 99-24275 for SEQ 1418, in complement
attgacatcaccaccaac

SEQ ID NO: 9284 - DNA, 21 bp, Homo Sapiens
  primer_bind 1..21: downstream amplification primer 99-24284 for SEQ 1419, in complement
cagatttaattttcctaagcc

SEQ ID NO: 9285 - DNA, 21 bp, Homo Sapiens
  primer_bind 1..21: downstream amplification primer 99-24286 for SEQ 1420, in complement
gacctccatagattaagaaac

SEQ ID NO: 9286 - DNA, 18 bp, Homo Sapiens
  primer_bind 1..18: downstream amplification primer 99-24288 for SEQ 1421, in complement
gccccattaattcctgtc

SEQ ID NO: 9287 - DNA, 21 bp, Homo Sapiens
  primer_bind 1..21: downstream amplification primer 99-24333 for SEQ 1422, in complement
gtttctgtgtatttgaatagc

SEQ ID NO: 9288 - DNA, 20 bp, Homo Sapiens
  primer_bind 1..20: downstream amplification primer 99-24342 for SEQ 1423, in complement
ttgattccatcctcctcgcc

SEQ ID NO: 9289 - DNA, 21 bp, Homo Sapiens
  primer_bind 1..21: downstream amplification primer 99-24376 for SEQ 1424, in complement
atcaaatcaaactccttgggg

SEQ ID NO: 9290 - DNA, 18 bp, Homo Sapiens
  primer_bind 1..18: downstream amplification primer 99-24379 for SEQ 1425, in complement
agctttgtggtagagctg

SEQ ID NO: 9291 - DNA, 19 bp, Homo Sapiens
  primer_bind 1..19: downstream amplification primer 99-24381 for SEQ 1426, in complement
catgatgccaacactgaag

SEQ ID NO: 9292 - DNA, 21 bp, Homo Sapiens
  primer_bind 1..21: downstream amplification primer 99-24385 for SEQ 1427, in complement
tgatcttttttccgtcatctg

SEQ ID NO: 9293 - DNA, 21 bp, Homo Sapiens
  primer_bind 1..21: downstream amplification primer 99-24388 for SEQ 1428, in complement
attacagagacgcaaaacgac

SEQ ID NO: 9294 - DNA, 19 bp, Homo Sapiens
  primer_bind 1..19: downstream amplification primer 99-24390 for SEQ 1429, in complement
catcacatctacaggaaac

SEQ ID NO: 9295 - DNA, 20 bp, Homo Sapiens
  primer_bind 1..20: downstream amplification primer 99-24392 for SEQ 1430, in complement
ctttgcgttagcctccacag

SEQ ID NO: 9296 - DNA, 18 bp, Homo Sapiens
  primer_bind 1..18: downstream amplification primer 99-24393 for SEQ 1431, in complement
gtcacaatgtcacatggc

SEQ ID NO: 9297 - DNA, 18 bp, Homo Sapiens
  primer_bind 1..18: downstream amplification primer 99-2440 for SEQ 1432, in complement
ccttctcatcacttcatc

SEQ ID NO: 9298 - DNA, 19 bp, Homo Sapiens
  primer_bind 1..19: downstream amplification primer 99-24409 for SEQ 1433, in complement
tccctgtctcagttccttc

SEQ ID NO: 9299 - DNA, 18 bp, Homo Sapiens
  primer_bind 1..18: downstream amplification primer 99-24411 for SEQ 1434, in complement
tcaaacagaagggcagag

SEQ ID NO: 9300 - DNA, 18 bp, Homo Sapiens
  primer_bind 1..18: downstream amplification primer 99-24427 for SEQ 1435, in complement
gtaggaggagaacatctg

SEQ ID NO: 9301 - DNA, 21 bp, Homo Sapiens
  primer_bind 1..21: downstream amplification primer 99-24432 for SEQ 1436, in complement
ttaagcctcctttcacaagcc

SEQ ID NO: 9302 - DNA, 18 bp, Homo Sapiens
  primer_bind 1..18: downstream amplification primer 99-24438 for SEQ 1437, in complement
gggagggagatgtatttg

SEQ ID NO: 9303 - DNA, 21 bp, Homo Sapiens
  primer_bind 1..21: downstream amplification primer 99-24441 for SEQ 1438, in complement
gtgtggtaaactttttgaagg

SEQ ID NO: 9304 - DNA, 21 bp, Homo Sapiens
  primer_bind 1..21: downstream amplification primer 99-24447 for SEQ 1439, in complement
atagagatgaggaaatgaggg

SEQ ID NO: 9305 - DNA, 19 bp, Homo Sapiens
  primer_bind 1..19: downstream amplification primer 99-2445 for SEQ 1440, in complement
ctcagagaaaggaagatgc

SEQ ID NO: 9306 - DNA, 21 bp, Homo Sapiens
  primer_bind 1..21: downstream amplification primer 99-24454 for SEQ 1441, in complement
gtaattgagaaatctacagac

SEQ ID NO: 9307 - DNA, 21 bp, Homo Sapiens
  primer_bind 1..21: downstream amplification primer 99-24463 for SEQ 1442, in complement
agtcttagacacacctatccc

SEQ ID NO: 9308 - DNA, 21 bp, Homo Sapiens
  primer_bind 1..21: downstream amplification primer 99-24496 for SEQ 1443, in complement
atagtggctcatgccatcatc

SEQ ID NO: 9309 - DNA, 20 bp, Homo Sapiens
  primer_bind 1..20: downstream amplification primer 99-24506 for SEQ 1444, in complement
acaccacagatgtctccacc

SEQ ID NO: 9310 - DNA, 20 bp, Homo Sapiens
  primer_bind 1..20: downstream amplification primer 99-24508 for SEQ 1445, in complement
cacaagtttctcattagacc

SEQ ID NO: 9311 - DNA, 21 bp, Homo Sapiens
  primer_bind 1..21: downstream amplification primer 99-24529 for SEQ 1446, in complement
aagtagtagagaggtcatcag

SEQ ID NO: 9312 - DNA, 18 bp, Homo Sapiens
  primer_bind 1..18: downstream amplification primer 99-24534 for SEQ 1447, in complement
gacaaccattgtgttgag

SEQ ID NO: 9313 - DNA, 19 bp, Homo Sapiens
  primer_bind 1..19: downstream amplification primer 99-24554 for SEQ 1448, in complement
tgtcatcgtcatcctcctc

SEQ ID NO: 9314 - DNA, 21 bp, Homo Sapiens
  primer_bind 1..21: downstream amplification primer 99-24557 for SEQ 1449, in complement
gtagtatgcaccagtccagtc

SEQ ID NO: 9315 - DNA, 18 bp, Homo Sapiens
  primer_bind 1..18: downstream amplification primer 99-24561 for SEQ 1450, in complement
aggagtttggcttcagag

SEQ ID NO: 9316 - DNA, 18 bp, Homo Sapiens
  primer_bind 1..18: downstream amplification primer 99-24570 for SEQ 1451, in complement
taggctttgaagggagtg

SEQ ID NO: 9317 - DNA, 20 bp, Homo Sapiens
  primer_bind 1..20: downstream amplification primer 99-24688 for SEQ 1452, in complement
ccaatttcctgcaaaatacc

SEQ ID NO: 9318 - DNA, 18 bp, Homo Sapiens
  primer_bind 1..18: downstream amplification primer 99-24725 for SEQ 1453, in complement
agcgagaaatgtgatgtg

SEQ ID NO: 9319 - DNA, 21 bp, Homo Sapiens
  primer_bind 1..21: downstream amplification primer 99-24727 for SEQ 1454, in complement
atatcagtgtattcaacagag

SEQ ID NO: 9320 - DNA, 21 bp, Homo Sapiens
  primer_bind 1..21: downstream amplification primer 99-24750 for SEQ 1455, in complement
catttacatgagtatgcttgg

SEQ ID NO: 9321 - DNA, 18 bp, Homo Sapiens
  primer_bind 1..18: downstream amplification primer 99-24778 for SEQ 1456, in complement
atgagttcccagtctaag

SEQ ID NO: 9322 - DNA, 21 bp, Homo Sapiens
  primer_bind 1..21: downstream amplification primer 99-24793 for SEQ 1457, in complement
gtattgggttatggcaagtgg

SEQ ID NO: 9323 - DNA, 21 bp, Homo Sapiens
  primer_bind 1..21: downstream amplification primer 99-24800 for SEQ 1458, in complement
aaataatctgtgtctgtcctg

SEQ ID NO: 9324 - DNA, 19 bp, Homo Sapiens
  primer_bind 1..19: downstream amplification primer 99-25005 for SEQ 1459, in complement
ctgtgaaaaagagactgtg

SEQ ID NO: 9325 - DNA, 20 bp, Homo Sapiens
  primer_bind 1..20: downstream amplification primer 99-25007 for SEQ 1460, in complement
gatcctgaaggtaaatcctg

SEQ ID NO: 9326 - DNA, 21 bp, Homo Sapiens
  primer_bind 1..21: downstream amplification primer 99-25053 for SEQ 1461, in complement
aagatagaggagaaagaaagg

SEQ ID NO: 9327 - DNA, 19 bp, Homo Sapiens
  primer_bind 1..19: downstream amplification primer 99-25055 for SEQ 1462, in complement
atatgatctgtgttcatgg

SEQ ID NO: 9328 - DNA, 21 bp, Homo Sapiens
  primer_bind 1..21: downstream amplification primer 99-25070 for SEQ 1463, in complement
gagacagaaataatttgtgag

SEQ ID NO: 9329 - DNA, 19 bp, Homo Sapiens
  primer_bind 1..19: downstream amplification primer 99-25077 for SEQ 1464, in complement
agtagcaggtcaggaagag

SEQ ID NO: 9330 - DNA, 18 bp, Homo Sapiens
  primer_bind 1..18: downstream amplification primer 99-25129 for SEQ 1465, in complement
accttccattgtccactc

SEQ ID NO: 9331 - DNA, 21 bp, Homo Sapiens
  primer_bind 1..21: downstream amplification primer 99-25134 for SEQ 1466, in complement
acaccacactctctataccac

SEQ ID NO: 9332 - DNA, 19 bp, Homo Sapiens
  primer_bind 1..19: downstream amplification primer 99-2524 for SEQ 1467, in complement
atggctgcctgagaatcac

SEQ ID NO: 9333 - DNA, 19 bp, Homo Sapiens
  primer_bind 1..19: downstream amplification primer 99-25246 for SEQ 1468, in complement
tgcgtttctcgtctgagtg

SEQ ID NO: 9334 - DNA, 19 bp, Homo Sapiens
  primer_bind 1..19: downstream amplification primer 99-25249 for SEQ 1469, in complement
acagcctctctatacggtg

SEQ ID NO: 9335 - DNA, 19 bp, Homo Sapiens
  primer_bind 1..19: downstream amplification primer 99-2525 for SEQ 1470, in complement
gctctgcttgtgattattg

SEQ ID NO: 9336 - DNA, 21 bp, Homo Sapiens
  primer_bind 1..21: downstream amplification primer 99-25255 for SEQ 1471, in complement
agagaattggttggatctgag

SEQ ID NO: 9337 - DNA, 18 bp, Homo Sapiens
  primer_bind 1..18: downstream amplification primer 99-25369 for SEQ 1472, in complement
tttggatgcagtggttag

SEQ ID NO: 9338 - DNA, 18 bp, Homo Sapiens
  primer_bind 1..18: downstream amplification primer 99-25379 for SEQ 1473, in complement
aaacagagaagggatggg

SEQ ID NO: 9339 - DNA, 19 bp, Homo Sapiens
  primer_bind 1..19: downstream amplification primer 99-25382 for SEQ 1474, in complement
aaccatttctgcctcctcc

SEQ ID NO: 9340 - DNA, 20 bp, Homo Sapiens
  primer_bind 1..20: downstream amplification primer 99-25387 for SEQ 1475, in complement
tttgcacctgctctgtgacc

SEQ ID NO: 9341 - DNA, 21 bp, Homo Sapiens
  primer_bind 1..21: downstream amplification primer 99-25400 for SEQ 1476, in complement
catcactgtattacaaaagcc

SEQ ID NO: 9342 - DNA, 18 bp, Homo Sapiens
  primer_bind 1..18: downstream amplification primer 99-25412 for SEQ 1477, in complement
gcatagcatttgtcagag

SEQ ID NO: 9343 - DNA, 21 bp, Homo Sapiens
  primer_bind 1..21: downstream amplification primer 99-25431 for SEQ 1478, in complement
tgttctttaagtgctgaatgg

SEQ ID NO: 9344 - DNA, 21 bp, Homo Sapiens
  primer_bind 1..21: downstream amplification primer 99-25432 for SEQ 1479, in complement
agaatgacatggcttgatagg

SEQ ID NO: 9345 - DNA, 18 bp, Homo Sapiens
  primer_bind 1..18: downstream amplification primer 99-25433 for SEQ 1480, in complement
caagatagtcgtgagctg

SEQ ID NO: 9346 - DNA, 21 bp, Homo Sapiens
  primer_bind 1..21: downstream amplification primer 99-25447 for SEQ 1481, in complement
ccaatagtgtcttttgtgacc

SEQ ID NO: 9347 - DNA, 20 bp, Homo Sapiens
  primer_bind 1..20: downstream amplification primer 99-25448 for SEQ 1482, in complement
ttaagtcctcaagtggtagc

SEQ ID NO: 9348 - DNA, 21 bp, Homo Sapiens
  primer_bind 1..21: downstream amplification primer 99-25452 for SEQ 1483, in complement
gacttccatactaagaaactc

SEQ ID NO: 9349 - DNA, 21 bp, Homo Sapiens
  primer_bind 1..21: downstream amplification primer 99-25454 for SEQ 1484, in complement
cctgtcaattagcaaggagtc

SEQ ID NO: 9350 - DNA, 18 bp, Homo Sapiens
  primer_bind 1..18: downstream amplification primer 99-25458 for SEQ 1485, in complement
gtgtctgccttatctttc

SEQ ID NO: 9351 - DNA, 21 bp, Homo Sapiens
  primer_bind 1..21: downstream amplification primer 99-25503 for SEQ 1486, in complement
gccagagtctttactttctac

SEQ ID NO: 9352 - DNA, 21 bp, Homo Sapiens
  primer_bind 1..21: downstream amplification primer 99-25507 for SEQ 1487, in complement
ccacattgcattctattttag

SEQ ID NO: 9353 - DNA, 21 bp, Homo Sapiens
  primer_bind 1..21: downstream amplification primer 99-25510 for SEQ 1488, in complement
atctattacctgtactctccc

SEQ ID NO: 9354 - DNA, 18 bp, Homo Sapiens
  primer_bind 1..18: downstream amplification primer 99-25538 for SEQ 1489, in complement
ctcaatcactccatcttc

SEQ ID NO: 9355 - DNA, 19 bp, Homo Sapiens
  primer_bind 1..19: downstream amplification primer 99-25539 for SEQ 1490, in complement
ccataaacatttctcagtg

SEQ ID NO: 9356 - DNA, 21 bp, Homo Sapiens
  primer_bind 1..21: downstream amplification primer 99-25543 for SEQ 1491, in complement
attgcctttatgagttgaatc

SEQ ID NO: 9357 - DNA, 21 bp, Homo Sapiens
  primer_bind 1..21: downstream amplification primer 99-25575 for SEQ 1492, in complement
tttgtcccgatttagtaattg

SEQ ID NO: 9358 - DNA, 21 bp, Homo Sapiens
  primer_bind 1..21: downstream amplification primer 99-25618 for SEQ 1493, in complement
tgaaagaaagaatgagggagg

SEQ ID NO: 9359 - DNA, 21 bp, Homo Sapiens
  primer_bind 1..21: downstream amplification primer 99-25620 for SEQ 1494, in complement
gcatgtgtttgcagattcttg

SEQ ID NO: 9360 - DNA, 18 bp, Homo Sapiens
  primer_bind 1..18: downstream amplification primer 99-25629 for SEQ 1495, in complement
ttctgcacacagatgcac

SEQ ID NO: 9361 - DNA, 20 bp, Homo Sapiens
  primer_bind 1..20: downstream amplification primer 99-25657 for SEQ 1496, in complement
caataagactcttgtagtcc

SEQ ID NO: 9362 - DNA, 21 bp, Homo Sapiens
  primer_bind 1..21: downstream amplification primer 99-25672 for SEQ 1497, in complement
agggaatttctctgttgtgtg

SEQ ID NO: 9363 - DNA, 21 bp, Homo Sapiens
  primer_bind 1..21: downstream amplification primer 99-25676 for SEQ 1498, in complement
ctctcctagcttttaaagatg

SEQ ID NO: 9364 - DNA, 21 bp, Homo Sapiens
  primer_bind 1..21: downstream amplification primer 99-25678 for SEQ 1499, in complement
ctgttactgaaaatacttacc

SEQ ID NO: 9365 - DNA, 21 bp, Homo Sapiens
  primer_bind 1..21: downstream amplification primer 99-2570 for SEQ 1500, in complement
tggtggtggaaaaaaagaagg

SEQ ID NO: 9366 - DNA, 21 bp, Homo Sapiens
  primer_bind 1..21: downstream amplification primer 99-25712 for SEQ 1501, in complement
ggttaggagagaacactaagg

SEQ ID NO: 9367 - DNA, 19 bp, Homo Sapiens
  primer_bind 1..19: downstream amplification primer 99-25716 for SEQ 1502, in complement
tattcctgtagctctgccc

SEQ ID NO: 9368 - DNA, 18 bp, Homo Sapiens
  primer_bind 1..18: downstream amplification primer 99-25717 for SEQ 1503, in complement
agcaggaagataacacac

SEQ ID NO: 9369 - DNA, 21 bp, Homo Sapiens
  primer_bind 1..21: downstream amplification primer 99-25725 for SEQ 1504, in complement
ttgaaagattagaagtgaagg

SEQ ID NO: 9370 - DNA, 19 bp, Homo Sapiens
  primer_bind 1..19: downstream amplification primer 99-25732 for SEQ 1505, in complement
catttagagaactgactcc

SEQ ID NO: 9371 - DNA, 21 bp, Homo Sapiens
  primer_bind 1..21: downstream amplification primer 99-25745 for SEQ 1506, in complement
agggattctacaggaaaaatg

SEQ ID NO: 9372 - DNA, 19 bp, Homo Sapiens
  primer_bind 1..19: downstream amplification primer 99-25781 for SEQ 1507, in complement
aagaagtaaataggggatg

SEQ ID NO: 9373 - DNA, 19 bp, Homo Sapiens
  primer_bind 1..19: downstream amplification primer 99-25836 for SEQ 1508, in complement
atgctttcacccaaaaatg

SEQ ID NO: 9374 - DNA, 18 bp, Homo Sapiens
  primer_bind 1..18: downstream amplification primer 99-2597 for SEQ 1509, in complement
tttaaacctggacacgag

SEQ ID NO: 9375 - DNA, 18 bp, Homo Sapiens
  primer_bind 1..18: downstream amplification primer 99-26001 for SEQ 1510, in complement
cgagatgcagcttgtatg

SEQ ID NO: 9376 - DNA, 18 bp, Homo Sapiens
  primer_bind 1..18: downstream amplification primer 99-26002 for SEQ 1511, in complement
ggctcaactattagggtg

SEQ ID NO: 9377 - DNA, 18 bp, Homo Sapiens
  primer_bind 1..18: downstream amplification primer 99-26042 for SEQ 1512, in complement
ctattttggcactgcgtc

SEQ ID NO: 9378 - DNA, 18 bp, Homo Sapiens
  primer_bind 1..18: downstream amplification primer 99-26080 for SEQ 1513, in complement
caaagagggctgaaatac

SEQ ID NO: 9379 - DNA, 21 bp, Homo Sapiens
  primer_bind 1..21: downstream amplification primer 99-26082 for SEQ 1514, in complement
tttcaagtacacactctaagg

SEQ ID NO: 9380 - DNA, 19 bp, Homo Sapiens
  primer_bind 1..19: downstream amplification primer 99-26099 for SEQ 1515, in complement
gtcttattgattggatagg

SEQ ID NO: 9381 - DNA, 20 bp, Homo Sapiens
  primer_bind 1..20: downstream amplification primer 99-2610 for SEQ 1516, in complement
aggtcactcaagtattatgg

SEQ ID NO: 9382 - DNA, 19 bp, Homo Sapiens
  primer_bind 1..19: downstream amplification primer 99-26105 for SEQ 1517, in complement
ctttagtgttgttctctgg

SEQ ID NO: 9383 - DNA, 19 bp, Homo Sapiens
  primer_bind 1..19: downstream amplification primer 99-26116 for SEQ 1518, in complement
ccatttccaccaaaatgac

SEQ ID NO: 9384 - DNA, 21 bp, Homo Sapiens
  primer_bind 1..21: downstream amplification primer 99-2615 for SEQ 1519, in complement
ccccagctcccaaataatgac

SEQ ID NO: 9385 - DNA, 20 bp, Homo Sapiens
  primer_bind 1..20: downstream amplification primer 99-2620 for SEQ 1520, in complement
tccacaacagacacttaaac

SEQ ID NO: 9386 - DNA, 18 bp, Homo Sapiens
  primer_bind 1..18: downstream amplification primer 99-2624 for SEQ 1521, in complement
tctctttccccatctctc

SEQ ID NO: 9387 - DNA, 19 bp, Homo Sapiens
  primer_bind 1..19: downstream amplification primer 99-2625 for SEQ 1522, in complement
tccccttctattgtctacc

SEQ ID NO: 9388 - DNA, 18 bp, Homo Sapiens
  primer_bind 1..18: downstream amplification primer 99-2637 for SEQ 1523, in complement
cctccaacagtaagaatc

SEQ ID NO: 9389 - DNA, 21 bp, Homo Sapiens
  primer_bind 1..21: downstream amplification primer 99-2662 for SEQ 1524, in complement
gataaaaggcttgaaatgggg

SEQ ID NO: 9390 - DNA, 19 bp, Homo Sapiens
  primer_bind 1..19: downstream amplification primer 99-2669 for SEQ 1525, in complement
gaattgaatgaaggtctac

SEQ ID NO: 9391 - DNA, 21 bp, Homo Sapiens
  primer_bind 1..21: downstream amplification primer 99-2675 for SEQ 1526, in complement
agatcaaagttttgacattcc

SEQ ID NO: 9392 - DNA, 20 bp, Homo Sapiens
  primer_bind 1..20: downstream amplification primer 99-2683 for SEQ 1527, in complement
ggatgatttgggtgttttag

SEQ ID NO: 9393 - DNA, 21 bp, Homo Sapiens
  primer_bind 1..21: downstream amplification primer 99-342 for SEQ 1528, in complement
caacccagtgtatagttagag

SEQ ID NO: 9394 - DNA, 18 bp, Homo Sapiens
  primer_bind 1..18: downstream amplification primer 99-370 for SEQ 1529, in complement
tctgtgccttgtcttctc

SEQ ID NO: 9395 - DNA, 20 bp, Homo Sapiens
  primer_bind 1..20: downstream amplification primer 99-371 for SEQ 1530, in complement
gtatgtgataatgtcacgag

SEQ ID NO: 9396 - DNA, 21 bp, Homo Sapiens
  primer_bind 1..21: downstream amplification primer 99-388 for SEQ 1531, in complement
aaaccattacttcaactatcc

SEQ ID NO: 9397 - DNA, 18 bp, Homo Sapiens
  primer_bind 1..18: downstream amplification primer 99-390 for SEQ 1532, in complement
ttatggtctgaagggaac

SEQ ID NO: 9398 - DNA, 18 bp, Homo Sapiens
  primer_bind 1..18: downstream amplification primer 99-393 for SEQ 1533, in complement
gatgttctgaggaaagag

SEQ ID NO: 9399 - DNA, 18 bp, Homo Sapiens
  primer_bind 1..18: downstream amplification primer 99-397 for SEQ 1534, in complement
tctgtgccttgtcttctc

SEQ ID NO: 9400 - DNA, 21 bp, Homo Sapiens
  primer_bind 1..21: downstream amplification primer 99-400 for SEQ 1535, in complement
gaaacaaggaaataaagcaag

SEQ ID NO: 9401 - DNA, 20 bp, Homo Sapiens
  primer_bind 1..20: downstream amplification primer 99-402 for SEQ 1536, in complement
atgccgtcctttatcagatg

SEQ ID NO: 9402 - DNA, 21 bp, Homo Sapiens
  primer_bind 1..21: downstream amplification primer 99-404 for SEQ 1537, in complement
tctactacacactaaccacac

SEQ ID NO: 9403 - DNA, 19 bp, Homo Sapiens
  primer_bind 1..19: downstream amplification primer 99-414 for SEQ 1538, in complement
ctagacaatatcctctcac

SEQ ID NO: 9404 - DNA, 18 bp, Homo Sapiens
  primer_bind 1..18: downstream amplification primer 99-417 for SEQ 1539, in complement
tgattcctaacccatgtg

SEQ ID NO: 9405 - DNA, 21 bp, Homo Sapiens
  primer_bind 1..21: downstream amplification primer 99-426 for SEQ 1540, in complement
acaggtatgaagacaaaaagg

SEQ ID NO: 9406 - DNA, 19 bp, Homo Sapiens
  primer_bind 1..19: downstream amplification primer 99-429 for SEQ 1541, in complement
aacgcagggatctgacaag

SEQ ID NO: 9407 - DNA, 18 bp, Homo Sapiens
  primer_bind 1..18: downstream amplification primer 99-430 for SEQ 1542, in complement
agaaatgctgactgtctg

SEQ ID NO: 9408 - DNA, 21 bp, Homo Sapiens
  primer_bind 1..21: downstream amplification primer 99-435 for SEQ 1543, in complement
ctctcagaaaactagaaatag

SEQ ID NO: 9409 - DNA, 20 bp, Homo Sapiens
  primer_bind 1..20: downstream amplification primer 99-449 for SEQ 1544, in complement
atcatctccccctccaactc

SEQ ID NO: 9410 - DNA, 20 bp, Homo Sapiens
  primer_bind 1..20: downstream amplification primer 99-4536 for SEQ 1545, in complement
ggatatacagttgacccttg

SEQ ID NO: 9411 - DNA, 18 bp, Homo Sapiens
  primer_bind 1..18: downstream amplification primer 99-4541 for SEQ 1546, in complement
cacactccatctattctg

SEQ ID NO: 9412 - DNA, 18 bp, Homo Sapiens
  primer_bind 1..18: downstream amplification primer 99-4544 for SEQ 1547, in complement
gagccttaggcatcattg

SEQ ID NO: 9413 - DNA, 19 bp, Homo Sapiens
  primer_bind 1..19: downstream amplification primer 99-4547 for SEQ 1548, in complement
accctgaataagagaatac

SEQ ID NO: 9414 - DNA, 20 bp, Homo Sapiens
  primer_bind 1..20: downstream amplification primer 99-4595 for SEQ 1549, in complement
tcttcctttctttccttcac

SEQ ID NO: 9415 - DNA, 21 bp, Homo Sapiens
  primer_bind 1..21: downstream amplification primer 99-4604 for SEQ 1550, in complement
gagagagagataaaattcaag

SEQ ID NO: 9416 - DNA, 21 bp, Homo Sapiens
  primer_bind 1..21: downstream amplification primer 99-4618 for SEQ 1551, in complement
ccttattgccagaaaacacac

SEQ ID NO: 9417 - DNA, 21 bp, Homo Sapiens
  primer_bind 1..21: downstream amplification primer 99-4625 for SEQ 1552, in complement
cttgaagtgggaaagaccttg

SEQ ID NO: 9418 - DNA, 18 bp, Homo Sapiens
  primer_bind 1..18: downstream amplification primer 99-4630 for SEQ 1553, in complement
cttcaggtgagcttcatc

SEQ ID NO: 9419 - DNA, 19 bp, Homo Sapiens
  primer_bind 1..19: downstream amplification primer 99-4644 for SEQ 1554, in complement
gtttgtttcttctcatgcc

SEQ ID NO: 9420 - DNA, 21 bp, Homo Sapiens
  primer_bind 1..21: downstream amplification primer 99-465 for SEQ 1555, in complement
caaaccttcacttctgtgttc

SEQ ID NO: 9421 - DNA, 20 bp, Homo Sapiens
  primer_bind 1..20: downstream amplification primer 99-4655 for SEQ 1556, in complement
accaagcagagggcagaaag

SEQ ID NO: 9422 - DNA, 19 bp, Homo Sapiens
  primer_bind 1..19: downstream amplification primer 99-466 for SEQ 1557, in complement
ttggggtgcagttccaatc

SEQ ID NO: 9423 - DNA, 20 bp, Homo Sapiens
  primer_bind 1..20: downstream amplification primer 99-4666 for SEQ 1558, in complement
tttgttggagaacaaagcag

SEQ ID NO: 9424 - DNA, 21 bp, Homo Sapiens
  primer_bind 1..21: downstream amplification primer 99-4674 for SEQ 1559, in complement
aacactttgaattgagacccc

SEQ ID NO: 9425 - DNA, 20 bp, Homo Sapiens
  primer_bind 1..20: downstream amplification primer 99-4676 for SEQ 1560, in complement
ggctatgttttacacttatc

SEQ ID NO: 9426 - DNA, 18 bp, Homo Sapiens
  primer_bind 1..18: downstream amplification primer 99-4677 for SEQ 1561, in complement
ctacaccacctgagtttg

SEQ ID NO: 9427 - DNA, 18 bp, Homo Sapiens
  primer_bind 1..18: downstream amplification primer 99-4679 for SEQ 1562, in complement
ccaccaatcaataagcac

SEQ ID NO: 9428 - DNA, 21 bp, Homo Sapiens
  primer_bind 1..21: downstream amplification primer 99-4680 for SEQ 1563, in complement
tacactggaaagcagttgagg

SEQ ID NO: 9429 - DNA, 18 bp, Homo Sapiens
  primer_bind 1..18: downstream amplification primer 99-4681 for SEQ 1564, in complement
tggttcaacccgttacag

SEQ ID NO: 9430 - DNA, 21 bp, Homo Sapiens
  primer_bind 1..21: downstream amplification primer 99-4682 for SEQ 1565, in complement
taattttacttcttccatccc

SEQ ID NO: 9431 - DNA, 19 bp, Homo Sapiens
  primer_bind 1..19: downstream amplification primer 99-4685 for SEQ 1566, in complement
tccaaagagagcctcatcc

SEQ ID NO: 9432 - DNA, 20 bp, Homo Sapiens
  primer_bind 1..20: downstream amplification primer 99-4705 for SEQ 1567, in complement
ctgccttcagcctaaaaaag

SEQ ID NO: 9433 - DNA, 19 bp, Homo Sapiens
  primer_bind 1..19: downstream amplification primer 99-4714 for SEQ 1568, in complement
tgccatactccagtctcag

SEQ ID NO: 9434 - DNA, 18 bp, Homo Sapiens
  primer_bind 1..18: downstream amplification primer 99-472 for SEQ 1569, in complement
atagactttgagcccctg

SEQ ID NO: 9435 - DNA, 20 bp, Homo Sapiens
  primer_bind 1..20: downstream amplification primer 99-4725 for SEQ 1570, in complement
cacaacaaaaccactcaatc

SEQ ID NO: 9436 - DNA, 18 bp, Homo Sapiens
  primer_bind 1..18: downstream amplification primer 99-4756 for SEQ 1571, in complement
ctcatctgtcttatcccc

SEQ ID NO: 9437 - DNA, 21 bp, Homo Sapiens
  primer_bind 1..21: downstream amplification primer 99-4761 for SEQ 1572, in complement
aaggcatactcaaggcaagtc

SEQ ID NO: 9438 - DNA, 21 bp, Homo Sapiens
  primer_bind 1..21: downstream amplification primer 99-477 for SEQ 1573, in complement
aaatctgtatggcatcctttg

SEQ ID NO: 9439 - DNA, 21 bp, Homo Sapiens
  primer_bind 1..21: downstream amplification primer 99-4777 for SEQ 1574, in complement
ttatctgtgatccacctgtgc

SEQ ID NO: 9440 - DNA, 19 bp, Homo Sapiens
  primer_bind 1..19: downstream amplification primer 99-4790 for SEQ 1575, in complement
gttagataaaggacaaagg

SEQ ID NO: 9441 - DNA, 19 bp, Homo Sapiens
  primer_bind 1..19: downstream amplification primer 99-4796 for SEQ 1576, in complement
gtgtttttaaccagtgttc

SEQ ID NO: 9442 - DNA, 21 bp, Homo Sapiens
  primer_bind 1..21: downstream amplification primer 99-482 for SEQ 1577, in complement
agtttcttccactattagcag

SEQ ID NO: 9443 - DNA, 18 bp, Homo Sapiens
  primer_bind 1..18: downstream amplification primer 99-4822 for SEQ 1578, in complement
cagaggtggattttggag

SEQ ID NO: 9444 - DNA, 20 bp, Homo Sapiens
  primer_bind 1..20: downstream amplification primer 99-4823 for SEQ 1579, in complement
cctttcctttccttattaac

SEQ ID NO: 9445 - DNA, 20 bp, Homo Sapiens
  primer_bind 1..20: downstream amplification primer 99-483 for SEQ 1580, in complement
gattatctatcagcatatcc

SEQ ID NO: 9446 - DNA, 21 bp, Homo Sapiens
  primer_bind 1..21: downstream amplification primer 99-4836 for SEQ 1581, in complement
tactctggatctatttgaaac

SEQ ID NO: 9447 - DNA, 20 bp, Homo Sapiens
  primer_bind 1..20: downstream amplification primer 99-4838 for SEQ 1582, in complement
aaggaaggggacagacacac

SEQ ID NO: 9448 - DNA, 21 bp, Homo Sapiens
  primer_bind 1..21: downstream amplification primer 99-4840 for SEQ 1583, in complement
gcaagtgtcatcaagcaaatg

SEQ ID NO: 9449 - DNA, 21 bp, Homo Sapiens
  primer_bind 1..21: downstream amplification primer 99-4844 for SEQ 1584, in complement
cacatgagaattgctacatgg

SEQ ID NO: 9450 - DNA, 21 bp, Homo Sapiens
  primer_bind 1..21: downstream amplification primer 99-486 for SEQ 1585, in complement
aagttttggggaggaatgagg

SEQ ID NO: 9451 - DNA, 19 bp, Homo Sapiens
  primer_bind 1..19: downstream amplification primer 99-4863 for SEQ 1586, in complement
cagtttttgttagtccttg

SEQ ID NO: 9452 - DNA, 18 bp, Homo Sapiens
  primer_bind 1..18: downstream amplification primer 99-4882 for SEQ 1587, in complement
acgggagacatccaacac

SEQ ID NO: 9453 - DNA, 20 bp, Homo Sapiens
  primer_bind 1..20: downstream amplification primer 99-4890 for SEQ 1588, in complement
ctcattcagtcttgagtagg

SEQ ID NO: 9454 - DNA, 21 bp, Homo Sapiens
  primer_bind 1..21: downstream amplification primer 99-4891 for SEQ 1589, in complement
cattgaaatcccaaagattcc

SEQ ID NO: 9455 - DNA, 19 bp, Homo Sapiens
  primer_bind 1..19: downstream amplification primer 99-4895 for SEQ 1590, in complement
actacctgcctcatttgcc

SEQ ID NO: 9456 - DNA, 18 bp, Homo Sapiens
  primer_bind 1..18: downstream amplification primer 99-490 for SEQ 1591, in complement
agaaaacattctctgggg

SEQ ID NO: 9457 - DNA, 21 bp, Homo Sapiens
  primer_bind 1..21: downstream amplification primer 99-4924 for SEQ 1592, in complement
ctcagctaagaagagagatgg

SEQ ID NO: 9458 - DNA, 20 bp, Homo Sapiens
  primer_bind 1..20: downstream amplification primer 99-4928 for SEQ 1593, in complement
ctgcttccttatcataagtc

SEQ ID NO: 9459 - DNA, 21 bp, Homo Sapiens
  primer_bind 1..21: downstream amplification primer 99-4950 for SEQ 1594, in complement
ccaaaacaaaaactccgctcc

SEQ ID NO: 9460 - DNA, 21 bp, Homo Sapiens
  primer_bind 1..21: downstream amplification primer 99-4951 for SEQ 1595, in complement
cttttgtatcttctccatccc

SEQ ID NO: 9461 - DNA, 21 bp, Homo Sapiens
  primer_bind 1..21: downstream amplification primer 99-4956 for SEQ 1596, in complement
atcgctcaatgatttacttag

SEQ ID NO: 9462 - DNA, 21 bp, Homo Sapiens
  primer_bind 1..21: downstream amplification primer 99-4966 for SEQ 1597, in complement
agtgtctgttatttgcctctc

SEQ ID NO: 9463 - DNA, 21 bp, Homo Sapiens
  primer_bind 1..21: downstream amplification primer 99-4968 for SEQ 1598, in complement
atgtgtaatgggcttgtatgg

SEQ ID NO: 9464 - DNA, 21 bp, Homo Sapiens
  primer_bind 1..21: downstream amplification primer 99-5016 for SEQ 1599, in complement
cagttaataagaaattgagcc

SEQ ID NO: 9465 - DNA, 21 bp, Homo Sapiens
  primer_bind 1..21: downstream amplification primer 99-5029 for SEQ 1600, in complement
tgccagggaatatcctgctac

SEQ ID NO: 9466 - DNA, 18 bp, Homo Sapiens
  primer_bind 1..18: downstream amplification primer 99-5032 for SEQ 1601, in complement
ccaaagtacaggaccaac

SEQ ID NO: 9467 - DNA, 21 bp, Homo Sapiens
  primer_bind 1..21: downstream amplification primer 99-5036 for SEQ 1602, in complement
gaactcttgacagtatgtatc

SEQ ID NO: 9468 - DNA, 18 bp, Homo Sapiens
  primer_bind 1..18: downstream amplification primer 99-5038 for SEQ 1603, in complement
tgtattctggagatcagc

SEQ ID NO: 9469 - DNA, 21 bp, Homo Sapiens
  primer_bind 1..21: downstream amplification primer 99-5043 for SEQ 1604, in complement
atcctttccacacatatcctc

SEQ ID NO: 9470 - DNA, 21 bp, Homo Sapiens
  primer_bind 1..21: downstream amplification primer 99-5099 for SEQ 1605, in complement
caacaggatgatatggtttgg

SEQ ID NO: 9471 - DNA, 18 bp, Homo Sapiens
  primer_bind 1..18: downstream amplification primer 99-5101 for SEQ 1606, in complement
tcctttttcttcaggcac

SEQ ID NO: 9472 - DNA, 19 bp, Homo Sapiens
  primer_bind 1..19: downstream amplification primer 99-5104 for SEQ 1607, in complement
gggaggaaaatgaaaggtg

SEQ ID NO: 9473 - DNA, 20 bp, Homo Sapiens
  primer_bind 1..20: downstream amplification primer 99-5107 for SEQ 1608, in complement
agatacagacttctctcagc

SEQ ID NO: 9474 - DNA, 19 bp, Homo Sapiens
  primer_bind 1..19: downstream amplification primer 99-5108 for SEQ 1609, in complement
atcaccacaggaagcagac

SEQ ID NO: 9475 - DNA, 21 bp, Homo Sapiens
  primer_bind 1..21: downstream amplification primer 99-511 for SEQ 1610, in complement
ctgttagaaactcaagcagtg

SEQ ID NO: 9476 - DNA, 19 bp, Homo Sapiens
  primer_bind 1..19: downstream amplification primer 99-5130 for SEQ 1611, in complement
gtggatacatggatagaag

SEQ ID NO: 9477 - DNA, 20 bp, Homo Sapiens
  primer_bind 1..20: downstream amplification primer 99-5142 for SEQ 1612, in complement
tttagagggaaatgaggaag

SEQ ID NO: 9478 - DNA, 21 bp, Homo Sapiens
  primer_bind 1..21: downstream amplification primer 99-5148 for SEQ 1613, in complement
gtctttttttcccctgtgttc

SEQ ID NO: 9479 - DNA, 20 bp, Homo Sapiens
  primer_bind 1..20: downstream amplification primer 99-5149 for SEQ 1614, in complement
gccaacatttagataaaccc

SEQ ID NO: 9480 - DNA, 21 bp, Homo Sapiens
  primer_bind 1..21: downstream amplification primer 99-5157 for SEQ 1615, in complement
tttacacaacccagtgccatc

SEQ ID NO: 9481 - DNA, 20 bp, Homo Sapiens
  primer_bind 1..20: downstream amplification primer 99-5162 for SEQ 1616, in complement
gcaatcctctttcacctgtc

SEQ ID NO: 9482 - DNA, 19 bp, Homo Sapiens
  primer_bind 1..19: downstream amplification primer 99-5168 for SEQ 1617, in complement
tatcattacagtaaacggg

SEQ ID NO: 9483 - DNA, 21 bp, Homo Sapiens
  primer_bind 1..21: downstream amplification primer 99-5184 for SEQ 1618, in complement
tgtatcttattcatccccctc

SEQ ID NO: 9484 - DNA, 21 bp, Homo Sapiens
  primer_bind 1..21: downstream amplification primer 99-5186 for SEQ 1619, in complement
gagtttaaaataccatgtgac

SEQ ID NO: 9485 - DNA, 20 bp, Homo Sapiens
  primer_bind 1..20: downstream amplification primer 99-5189 for SEQ 1620, in complement
ggtacatatttcttaatgcc

SEQ ID NO: 9486 - DNA, 18 bp, Homo Sapiens
  primer_bind 1..18: downstream amplification primer 99-5193 for SEQ 1621, in complement
gttgattcagcatctgcc

SEQ ID NO: 9487 - DNA, 19 bp, Homo Sapiens
  primer_bind 1..19: downstream amplification primer 99-5194 for SEQ 1622, in complement
aaggaactgggttagtgcc

SEQ ID NO: 9488 - DNA, 18 bp, Homo Sapiens
  primer_bind 1..18: downstream amplification primer 99-5199 for SEQ 1623, in complement
tagagttcagttgagtcc

SEQ ID NO: 9489 - DNA, 21 bp, Homo Sapiens
  primer_bind 1..21: downstream amplification primer 99-5202 for SEQ 1624, in complement
tgtatttctagggcactgagg

SEQ ID NO: 9490 - DNA, 21 bp, Homo Sapiens
  primer_bind 1..21: downstream amplification primer 99-5224 for SEQ 1625, in complement
gctaagagttattctgtttac

SEQ ID NO: 9491 - DNA, 18 bp, Homo Sapiens
  primer_bind 1..18: downstream amplification primer 99-5225 for SEQ 1626, in complement
gtgaaaggggaagcaaac

SEQ ID NO: 9492 - DNA, 20 bp, Homo Sapiens
  primer_bind 1..20: downstream amplification primer 99-5226 for SEQ 1627, in complement
gggtattttctcttacactc

SEQ ID NO: 9493 - DNA, 20 bp, Homo Sapiens
  primer_bind 1..20: downstream amplification primer 99-5247 for SEQ 1628, in complement
gggaaagtgtttgaaacaag

SEQ ID NO: 9494 - DNA, 18 bp, Homo Sapiens
  primer_bind 1..18: downstream amplification primer 99-5252 for SEQ 1629, in complement
caacacacatccaacaag

SEQ ID NO: 9495 - DNA, 21 bp, Homo Sapiens
  primer_bind 1..21: downstream amplification primer 99-5265 for SEQ 1630, in complement
gctaaggctcggtgtgaaatc

SEQ ID NO: 9496 - DNA, 19 bp, Homo Sapiens
  primer_bind 1..19: downstream amplification primer 99-5290 for SEQ 1631, in complement
aattgagaaaagttgtggg

SEQ ID NO: 9497 - DNA, 21 bp, Homo Sapiens
  primer_bind 1..21: downstream amplification primer 99-5291 for SEQ 1632, in complement
gttgtgttagtatagtgattg

SEQ ID NO: 9498 - DNA, 21 bp, Homo Sapiens
  primer_bind 1..21: downstream amplification primer 99-5294 for SEQ 1633, in complement
cataagatgattagaaccgcc

SEQ ID NO: 9499 - DNA, 21 bp, Homo Sapiens
  primer_bind 1..21: downstream amplification primer 99-5306 for SEQ 1634, in complement
cctgggcttacttacaattac

SEQ ID NO: 9500 - DNA, 21 bp, Homo Sapiens
  primer_bind 1..21: downstream amplification primer 99-5308 for SEQ 1635, in complement
acaaataccttgaacgcagcc

SEQ ID NO: 9501 - DNA, 21 bp, Homo Sapiens
  primer_bind 1..21: downstream amplification primer 99-5312 for SEQ 1636, in complement
catttaactcccacattagcc

SEQ ID NO: 9502 - DNA, 20 bp, Homo Sapiens
  primer_bind 1..20: downstream amplification primer 99-5326 for SEQ 1637, in complement
gtaacactgaaatcttttgg

SEQ ID NO: 9503 - DNA, 19 bp, Homo Sapiens
  primer_bind 1..19: downstream amplification primer 99-5338 for SEQ 1638, in complement
ccttctaccttcctttgtc

SEQ ID NO: 9504 - DNA, 18 bp, Homo Sapiens
  primer_bind 1..18: downstream amplification primer 99-5355 for SEQ 1639, in complement
agtggggcattttaagag

SEQ ID NO: 9505 - DNA, 19 bp, Homo Sapiens
  primer_bind 1..19: downstream amplification primer 99-5356 for SEQ 1640, in complement
tagaggaggaatgtggttg

SEQ ID NO: 9506 - DNA, 18 bp, Homo Sapiens
  primer_bind 1..18: downstream amplification primer 99-5360 for SEQ 1641, in complement
agtgacagatgacccaac

SEQ ID NO: 9507 - DNA, 19 bp, Homo Sapiens
  primer_bind 1..19: downstream amplification primer 99-5362 for SEQ 1642, in complement
ttccagggcaatcacagag

SEQ ID NO: 9508 - DNA, 21 bp, Homo Sapiens
  primer_bind 1..21: downstream amplification primer 99-5364 for SEQ 1643, in complement
gtaaataaagacccccaaacc

SEQ ID NO: 9509 - DNA, 18 bp, Homo Sapiens
  primer_bind 1..18: downstream amplification primer 99-5379 for SEQ 1644, in complement
ctatcctatttcctcacc

SEQ ID NO: 9510 - DNA, 19 bp, Homo Sapiens
  primer_bind 1..19: downstream amplification primer 99-5386 for SEQ 1645, in complement
tggggtatattaaacactg

SEQ ID NO: 9511 - DNA, 19 bp, Homo Sapiens
  primer_bind 1..19: downstream amplification primer 99-5389 for SEQ 1646, in complement
atccatcttcacacccaac

SEQ ID NO: 9512 - DNA, 20 bp, Homo Sapiens
  primer_bind 1..20: downstream amplification primer 99-5390 for SEQ 1647, in complement
actccaccttccaacaaccc

SEQ ID NO: 9513 - DNA, 20 bp, Homo Sapiens
  primer_bind 1..20: downstream amplification primer 99-5401 for SEQ 1648, in complement
tgggtgaaggcatgtactgg

SEQ ID NO: 9514 - DNA, 19 bp, Homo Sapiens
  primer_bind 1..19: downstream amplification primer 99-5405 for SEQ 1649, in complement
ccttacctcatcacttttc

SEQ ID NO: 9515 - DNA, 19 bp, Homo Sapiens
  primer_bind 1..19: downstream amplification primer 99-5406 for SEQ 1650, in complement
gaggcattcgcagaataag

SEQ ID NO: 9516 - DNA, 21 bp, Homo Sapiens
  primer_bind 1..21: downstream amplification primer 99-5407 for SEQ 1651, in complement
tgacttaggtttttctttcag

SEQ ID NO: 9517 - DNA, 19 bp, Homo Sapiens
  primer_bind 1..19: downstream amplification primer 99-5411 for SEQ 1652, in complement
gcatcttacaagcataagg

SEQ ID NO: 9518 - DNA, 20 bp, Homo Sapiens
  primer_bind 1..20: downstream amplification primer 99-5416 for SEQ 1653, in complement
cattattttcaaggcagagg

SEQ ID NO: 9519 - DNA, 19 bp, Homo Sapiens
  primer_bind 1..19: downstream amplification primer 99-5420 for SEQ 1654, in complement
aggtgatgggaataaatag

SEQ ID NO: 9520 - DNA, 21 bp, Homo Sapiens
  primer_bind 1..21: downstream amplification primer 99-5427 for SEQ 1655, in complement
tacaatcactaccttattccc

SEQ ID NO: 9521 - DNA, 18 bp, Homo Sapiens
  primer_bind 1..18: downstream amplification primer 99-5432 for SEQ 1656, in complement
ggcagtatagtggattag

SEQ ID NO: 9522 - DNA, 20 bp, Homo Sapiens
  primer_bind 1..20: downstream amplification primer 99-5433 for SEQ 1657, in complement
cctcattacttaacaatgtg

SEQ ID NO: 9523 - DNA, 21 bp, Homo Sapiens
  primer_bind 1..21: downstream amplification primer 99-5437 for SEQ 1658, in complement
cccaccccaattaatcacttc

SEQ ID NO: 9524 - DNA, 21 bp, Homo Sapiens
  primer_bind 1..21: downstream amplification primer 99-5438 for SEQ 1659, in complement
ttagtcaccgcattccaggag

SEQ ID NO: 9525 - DNA, 21 bp, Homo Sapiens
  primer_bind 1..21: downstream amplification primer 99-5441 for SEQ 1660, in complement
ggactcatacttacttatttc

SEQ ID NO: 9526 - DNA, 19 bp, Homo Sapiens
  primer_bind 1..19: downstream amplification primer 99-5446 for SEQ 1661, in complement
ccaagattgatctgtttcc

SEQ ID NO: 9527 - DNA, 20 bp, Homo Sapiens
  primer_bind 1..20: downstream amplification primer 99-5447 for SEQ 1662, in complement
ttcctatacaatcatacctc

SEQ ID NO: 9528 - DNA, 20 bp, Homo Sapiens
  primer_bind 1..20: downstream amplification primer 99-5458 for SEQ 1663, in complement
gatattctgcataatttgcc

SEQ ID NO: 9529 - DNA, 18 bp, Homo Sapiens
  primer_bind 1..18: downstream amplification primer 99-5468 for SEQ 1664, in complement
agcctgttcttagcaatc

SEQ ID NO: 9530 - DNA, 21 bp, Homo Sapiens
  primer_bind 1..21: downstream amplification primer 99-5472 for SEQ 1665, in complement
gcattgagatcctgttttagc

SEQ ID NO: 9531 - DNA, 21 bp, Homo Sapiens
  primer_bind 1..21: downstream amplification primer 99-5475 for SEQ 1666, in complement
tgaaacggaaagtccaagaac

SEQ ID NO: 9532 - DNA, 21 bp, Homo Sapiens
  primer_bind 1..21: downstream amplification primer 99-5477 for SEQ 1667, in complement
tgtctaacaacccgttttctc

SEQ ID NO: 9533 - DNA, 21 bp, Homo Sapiens
  primer_bind 1..21: downstream amplification primer 99-5485 for SEQ 1668, in complement
caaagaaggaagtgtatgagg

SEQ ID NO: 9534 - DNA, 18 bp, Homo Sapiens
  primer_bind 1..18: downstream amplification primer 99-5490 for SEQ 1669, in complement
cgggaagaagccattaag

SEQ ID NO: 9535 - DNA, 19 bp, Homo Sapiens
  primer_bind 1..19: downstream amplification primer 99-5494 for SEQ 1670, in complement
ttaaatgtcaagtcttccc

SEQ ID NO: 9536 - DNA, 21 bp, Homo Sapiens
  primer_bind 1..21: downstream amplification primer 99-5502 for SEQ 1671, in complement
ttatctgaaagcctgagaacc

SEQ ID NO: 9537 - DNA, 21 bp, Homo Sapiens
  primer_bind 1..21: downstream amplification primer 99-5505 for SEQ 1672, in complement
ctttactacggcaacctgaac

SEQ ID NO: 9538 - DNA, 21 bp, Homo Sapiens
  primer_bind 1..21: downstream amplification primer 99-5516 for SEQ 1673, in complement
attattagaaaggaaggtgag

SEQ ID NO: 9539 - DNA, 18 bp, Homo Sapiens
  primer_bind 1..18: downstream amplification primer 99-5526 for SEQ 1674, in complement
aatccacggatgcttgag

SEQ ID NO: 9540 - DNA, 21 bp, Homo Sapiens
  primer_bind 1..21: downstream amplification primer 99-5566 for SEQ 1675, in complement
ttgccctggatatttcttctg

SEQ ID NO: 9541 - DNA, 20 bp, Homo Sapiens
  primer_bind 1..20: downstream amplification primer 99-5582 for SEQ 1676, in complement
gacaaatagatgacaatgag

SEQ ID NO: 9542 - DNA, 21 bp, Homo Sapiens
  primer_bind 1..21: downstream amplification primer 99-5590 for SEQ 1677, in complement
tccttttcatagagaacttac

SEQ ID NO: 9543 - DNA, 18 bp, Homo Sapiens
  primer_bind 1..18: downstream amplification primer 99-5595 for SEQ 1678, in complement
actcaggttggacaagtg

SEQ ID NO: 9544 - DNA, 20 bp, Homo Sapiens
  primer_bind 1..20: downstream amplification primer 99-5596 for SEQ 1679, in complement
acagaaatctatttagccag

SEQ ID NO: 9545 - DNA, 21 bp, Homo Sapiens
  primer_bind 1..21: downstream amplification primer 99-5604 for SEQ 1680, in complement
ttgtctaaattccttgttcac

SEQ ID NO: 9546 - DNA, 21 bp, Homo Sapiens
  primer_bind 1..21: downstream amplification primer 99-5608 for SEQ 1681, in complement
caaaatgtctgttggattctc

SEQ ID NO: 9547 - DNA, 19 bp, Homo Sapiens
  primer_bind 1..19: downstream amplification primer 99-5632 for SEQ 1682, in complement
aggtcacaggttggacaag

SEQ ID NO: 9548 - DNA, 21 bp, Homo Sapiens
  primer_bind 1..21: downstream amplification primer 99-5633 for SEQ 1683, in complement
gggcaagttgaacatctggac

SEQ ID NO: 9549 - DNA, 21 bp, Homo Sapiens
  primer_bind 1..21: downstream amplification primer 99-5634 for SEQ 1684, in complement
ctcttttcactccatccatcc

SEQ ID NO: 9550 - DNA, 18 bp, Homo Sapiens
  primer_bind 1..18: downstream amplification primer 99-5636 for SEQ 1685, in complement
aacgaggcatttcaccag

SEQ ID NO: 9551 - DNA, 21 bp, Homo Sapiens
  primer_bind 1..21: downstream amplification primer 99-5660 for SEQ 1686, in complement
acaactctgtgtgagtcttgg

SEQ ID NO: 9552 - DNA, 18 bp, Homo Sapiens
  primer_bind 1..18: downstream amplification primer 99-5670 for SEQ 1687, in complement
gccttgtcaaatggtgtc

SEQ ID NO: 9553 - DNA, 20 bp, Homo Sapiens
  primer_bind 1..20: downstream amplification primer 99-5678 for SEQ 1688, in complement
tggataaaacactcaccatc

SEQ ID NO: 9554 - DNA, 19 bp, Homo Sapiens
  primer_bind 1..19: downstream amplification primer 99-5680 for SEQ 1689, in complement
ttgtgtgctcccaactgcc

SEQ ID NO: 9555 - DNA, 20 bp, Homo Sapiens
  primer_bind 1..20: downstream amplification primer 99-5681 for SEQ 1690, in complement
aatgagatagactgtgtctg

SEQ ID NO: 9556 - DNA, 20 bp, Homo Sapiens
  primer_bind 1..20: downstream amplification primer 99-5685 for SEQ 1691, in complement
ctctttgcccatccttcctc

SEQ ID NO: 9557 - DNA, 21 bp, Homo Sapiens
  primer_bind 1..21: downstream amplification primer 99-5686 for SEQ 1692, in complement
acaacagcaaatgaacctacc

SEQ ID NO: 9558 - DNA, 21 bp, Homo Sapiens
  primer_bind 1..21: downstream amplification primer 99-5700 for SEQ 1693, in complement
tattcttccctcagataccac

SEQ ID NO: 9559 - DNA, 21 bp, Homo Sapiens
  primer_bind 1..21: downstream amplification primer 99-5702 for SEQ 1694, in complement
actcactgggtaatcttagtc

SEQ ID NO: 9560 - DNA, 18 bp, Homo Sapiens
  primer_bind 1..18: downstream amplification primer 99-5703 for SEQ 1695, in complement
tacatcttttctgggtgg

SEQ ID NO: 9561 - DNA, 21 bp, Homo Sapiens
  primer_bind 1..21: downstream amplification primer 99-5709 for SEQ 1696, in complement
acattgtagcaccccaaagag

SEQ ID NO: 9562 - DNA, 21 bp, Homo Sapiens
  primer_bind 1..21: downstream amplification primer 99-5711 for SEQ 1697, in complement
ttcagaggaaaacctgctgtc

SEQ ID NO: 9563 - DNA, 21 bp, Homo Sapiens
  primer_bind 1..21: downstream amplification primer 99-5712 for SEQ 1698, in complement
gaggaggtagaaggagaagtg

SEQ ID NO: 9564 - DNA, 20 bp, Homo Sapiens
  primer_bind 1..20: downstream amplification primer 99-5727 for SEQ 1699, in complement
ttcattgtcagtggtcttgg

SEQ ID NO: 9565 - DNA, 20 bp, Homo Sapiens
  primer_bind 1..20: downstream amplification primer 99-5729 for SEQ 1700, in complement
aggactgtaatcagaagttg

SEQ ID NO: 9566 - DNA, 21 bp, Homo Sapiens
  primer_bind 1..21: downstream amplification primer 99-5731 for SEQ 1701, in complement
tctcttctgcttcttaaaagg

SEQ ID NO: 9567 - DNA, 19 bp, Homo Sapiens
  primer_bind 1..19: downstream amplification primer 99-5741 for SEQ 1702, in complement
tcccacagcccataaactc

SEQ ID NO: 9568 - DNA, 19 bp, Homo Sapiens
  primer_bind 1..19: downstream amplification primer 99-5742 for SEQ 1703, in complement
catgtcaaatgatcctgag

SEQ ID NO: 9569 - DNA, 19 bp, Homo Sapiens
  primer_bind 1..19: downstream amplification primer 99-5745 for SEQ 1704, in complement
cattcagggtggttttatc

SEQ ID NO: 9570 - DNA, 18 bp, Homo Sapiens
  primer_bind 1..18: downstream amplification primer 99-5756 for SEQ 1705, in complement
tctggaaacgatgctttg

SEQ ID NO: 9571 - DNA, 18 bp, Homo Sapiens
  primer_bind 1..18: downstream amplification primer 99-576 for SEQ 1706, in complement
cctagattccctaaggtg

SEQ ID NO: 9572 - DNA, 20 bp, Homo Sapiens
  primer_bind 1..20: downstream amplification primer 99-5760 for SEQ 1707, in complement
ctcttagaagcggaaatcac

SEQ ID NO: 9573 - DNA, 21 bp, Homo Sapiens
  primer_bind 1..21: downstream amplification primer 99-5770 for SEQ 1708, in complement
caaaattgccaatgtcacatc

SEQ ID NO: 9574 - DNA, 18 bp, Homo Sapiens
  primer_bind 1..18: downstream amplification primer 99-5781 for SEQ 1709, in complement
acctgatctagcctgaac

SEQ ID NO: 9575 - DNA, 21 bp, Homo Sapiens
  primer_bind 1..21: downstream amplification primer 99-5795 for SEQ 1710, in complement
gtccataccttaaaacatttc

SEQ ID NO: 9576 - DNA, 21 bp, Homo Sapiens
  primer_bind 1..21: downstream amplification primer 99-5813 for SEQ 1711, in complement
aatagatgtgcccacttgctg

SEQ ID NO: 9577 - DNA, 21 bp, Homo Sapiens
  primer_bind 1..21: downstream amplification primer 99-582 for SEQ 1712, in complement
gtatattgtggaggtgttttg

SEQ ID NO: 9578 - DNA, 21 bp, Homo Sapiens
  primer_bind 1..21: downstream amplification primer 99-5832 for SEQ 1713, in complement
gacatcaaaggatttgtttgg

SEQ ID NO: 9579 - DNA, 21 bp, Homo Sapiens
  primer_bind 1..21: downstream amplification primer 99-5836 for SEQ 1714, in complement
aatgttactgtgtttgtactg

SEQ ID NO: 9580 - DNA, 18 bp, Homo Sapiens
  primer_bind 1..18: downstream amplification primer 99-5837 for SEQ 1715, in complement
agttggaagtgaagagtg

SEQ ID NO: 9581 - DNA, 18 bp, Homo Sapiens
  primer_bind 1..18: downstream amplification primer 99-5860 for SEQ 1716, in complement
aacgacagcagaaacagg

SEQ ID NO: 9582 - DNA, 21 bp, Homo Sapiens
  primer_bind 1..21: downstream amplification primer 99-5867 for SEQ 1717, in complement
gtaatctgtgatacatttctc

SEQ ID NO: 9583 - DNA, 21 bp, Homo Sapiens
  primer_bind 1..21: downstream amplification primer 99-5875 for SEQ 1718, in complement
ggtagaggctatcttttattc

SEQ ID NO: 9584 - DNA, 18 bp, Homo Sapiens
  primer_bind 1..18: downstream amplification primer 99-5893 for SEQ 1719, in complement
tggggtcacacttgtatc

SEQ ID NO: 9585 - DNA, 21 bp, Homo Sapiens
  primer_bind 1..21: downstream amplification primer 99-5907 for SEQ 1720, in complement
gctactggggaaaaaaagatg

SEQ ID NO: 9586 - DNA, 21 bp, Homo Sapiens
  primer_bind 1..21: downstream amplification primer 99-5908 for SEQ 1721, in complement
ggttctgaactgggttctatg

SEQ ID NO: 9587 - DNA, 18 bp, Homo Sapiens
  primer_bind 1..18: downstream amplification primer 99-5909 for SEQ 1722, in complement
tcattcccatacctttcc

SEQ ID NO: 9588 - DNA, 18 bp, Homo Sapiens
  primer_bind 1..18: downstream amplification primer 99-5912 for SEQ 1723, in complement
ggatcaaaagtcaggcag

SEQ ID NO: 9589 - DNA, 21 bp, Homo Sapiens
  primer_bind 1..21: downstream amplification primer 99-5915 for SEQ 1724, in complement
aagttgtttgttactcaaggg

SEQ ID NO: 9590 - DNA, 21 bp, Homo Sapiens
  primer_bind 1..21: downstream amplification primer 99-5951 for SEQ 1725, in complement
tactttcattatttggcaagg

SEQ ID NO: 9591 - DNA, 21 bp, Homo Sapiens
  primer_bind 1..21: downstream amplification primer 99-5957 for SEQ 1726, in complement
acaccttcatcaaacatattc

SEQ ID NO: 9592 - DNA, 18 bp, Homo Sapiens
  primer_bind 1..18: downstream amplification primer 99-596 for SEQ 1727, in complement
atccagtcttccctgacc

SEQ ID NO: 9593 - DNA, 19 bp, Homo Sapiens
  primer_bind 1..19: downstream amplification primer 99-5968 for SEQ 1728, in complement
tgggcttgttgctcttgtg

SEQ ID NO: 9594 - DNA, 21 bp, Homo Sapiens
  primer_bind 1..21: downstream amplification primer 99-5979 for SEQ 1729, in complement
ctacactaacccatgaactac

SEQ ID NO: 9595 - DNA, 21 bp, Homo Sapiens
  primer_bind 1..21: downstream amplification primer 99-598 for SEQ 1730, in complement
agaatggaatgagatgaacag

SEQ ID NO: 9596 - DNA, 18 bp, Homo Sapiens
  primer_bind 1..18: downstream amplification primer 99-6007 for SEQ 1731, in complement
cagagtcaatcagggaag

SEQ ID NO: 9597 - DNA, 19 bp, Homo Sapiens
  primer_bind 1..19: downstream amplification primer 99-6012 for SEQ 1732, in complement
tatcctgggtgtatatatg

SEQ ID NO: 9598 - DNA, 21 bp, Homo Sapiens
  primer_bind 1..21: downstream amplification primer 99-602 for SEQ 1733, in complement
cttgtaatctgtggaaaactg

SEQ ID NO: 9599 - DNA, 18 bp, Homo Sapiens
  primer_bind 1..18: downstream amplification primer 99-6038 for SEQ 1734, in complement
tagtgtcatcctgccatc

SEQ ID NO: 9600 - DNA, 21 bp, Homo Sapiens
  primer_bind 1..21: downstream amplification primer 99-6042 for SEQ 1735, in complement
tgattactttgaagggaacac

SEQ ID NO: 9601 - DNA, 21 bp, Homo Sapiens
  primer_bind 1..21: downstream amplification primer 99-6051 for SEQ 1736, in complement
ctatgtgtcagttactgtgtc

SEQ ID NO: 9602 - DNA, 21 bp, Homo Sapiens
  primer_bind 1..21: downstream amplification primer 99-6067 for SEQ 1737, in complement
taaatctcctttaccactatg

SEQ ID NO: 9603 - DNA, 21 bp, Homo Sapiens
  primer_bind 1..21: downstream amplification primer 99-6069 for SEQ 1738, in complement
tatactcagcaaatgataagg

SEQ ID NO: 9604 - DNA, 18 bp, Homo Sapiens
  primer_bind 1..18: downstream amplification primer 99-607 for SEQ 1739, in complement
ctcttcctttccttcttc

SEQ ID NO: 9605 - DNA, 18 bp, Homo Sapiens
  primer_bind 1..18: downstream amplification primer 99-6077 for SEQ 1740, in complement
tccccattcctctctctc

SEQ ID NO: 9606 - DNA, 21 bp, Homo Sapiens
  primer_bind 1..21: downstream amplification primer 99-6079 for SEQ 1741, in complement
atacacacacaacacataaac

SEQ ID NO: 9607 - DNA, 21 bp, Homo Sapiens
  primer_bind 1..21: downstream amplification primer 99-608 for SEQ 1742, in complement
actatacataactgctttctg

SEQ ID NO: 9608 - DNA, 21 bp, Homo Sapiens
  primer_bind 1..21: downstream amplification primer 99-6080 for SEQ 1743, in complement
tgtgaatgcgtattgtctgtg

SEQ ID NO: 9609 - DNA, 21 bp, Homo Sapiens
  primer_bind 1..21: downstream amplification primer 99-609 for SEQ 1744, in complement
ccagaataaaaacttagcacc

SEQ ID NO: 9610 - DNA, 21 bp, Homo Sapiens
  primer_bind 1..21: downstream amplification primer 99-6091 for SEQ 1745, in complement
cagacaaaaaagacaaatcac

SEQ ID NO: 9611 - DNA, 21 bp, Homo Sapiens
  primer_bind 1..21: downstream amplification primer 99-6094 for SEQ 1746, in complement
tctgtatggcagtaagttagg

SEQ ID NO: 9612 - DNA, 18 bp, Homo Sapiens
  primer_bind 1..18: downstream amplification primer 99-6095 for SEQ 1747, in complement
agaatcactgctgaaggg

SEQ ID NO: 9613 - DNA, 21 bp, Homo Sapiens
  primer_bind 1..21: downstream amplification primer 99-6097 for SEQ 1748, in complement
actaccttgcttgaatggctg

SEQ ID NO: 9614 - DNA, 18 bp, Homo Sapiens
  primer_bind 1..18: downstream amplification primer 99-610 for SEQ 1749, in complement
ctggtccgcatctaattc

SEQ ID NO: 9615 - DNA, 21 bp, Homo Sapiens
  primer_bind 1..21: downstream amplification primer 99-6112 for SEQ 1750, in complement
ctgtgatatttccaattcctg

SEQ ID NO: 9616 - DNA, 21 bp, Homo Sapiens
  primer_bind 1..21: downstream amplification primer 99-6117 for SEQ 1751, in complement
ggatattggatatatagtagg

SEQ ID NO: 9617 - DNA, 19 bp, Homo Sapiens
  primer_bind 1..19: downstream amplification primer 99-6122 for SEQ 1752, in complement
agatacgcttggcttgcac

SEQ ID NO: 9618 - DNA, 18 bp, Homo Sapiens
  primer_bind 1..18: downstream amplification primer 99-6131 for SEQ 1753, in complement
ccttccacaacctttttc

SEQ ID NO: 9619 - DNA, 20 bp, Homo Sapiens
  primer_bind 1..20: downstream amplification primer 99-6135 for SEQ 1754, in complement
aagaaatgagacgattcagc

SEQ ID NO: 9620 - DNA, 21 bp, Homo Sapiens
  primer_bind 1..21: downstream amplification primer 99-614 for SEQ 1755, in complement
tcgctggaacattctggacac

SEQ ID NO: 9621 - DNA, 21 bp, Homo Sapiens
  primer_bind 1..21: downstream amplification primer 99-6141 for SEQ 1756, in complement
cattcatccaatacccctatc

SEQ ID NO: 9622 - DNA, 21 bp, Homo Sapiens
  primer_bind 1..21: downstream amplification primer 99-615 for SEQ 1757, in complement
catcttctgttggtcatttgg

SEQ ID NO: 9623 - DNA, 19 bp, Homo Sapiens
  primer_bind 1..19: downstream amplification primer 99-616 for SEQ 1758, in complement
gctttcagtgcgaataaac

SEQ ID NO: 9624 - DNA, 21 bp, Homo Sapiens
  primer_bind 1..21: downstream amplification primer 99-6176 for SEQ 1759, in complement
ttcttatcttcctcttatgtc

SEQ ID NO: 9625 - DNA, 18 bp, Homo Sapiens
  primer_bind 1..18: downstream amplification primer 99-6180 for SEQ 1760, in complement
ttccagtggcaataggag

SEQ ID NO: 9626 - DNA, 21 bp, Homo Sapiens
  primer_bind 1..21: downstream amplification primer 99-6181 for SEQ 1761, in complement
gtccaagaaatcaacaccaag

SEQ ID NO: 9627 - DNA, 21 bp, Homo Sapiens
  primer_bind 1..21: downstream amplification primer 99-6189 for SEQ 1762, in complement
cctcttactagcatgaatgac

SEQ ID NO: 9628 - DNA, 18 bp, Homo Sapiens
  primer_bind 1..18: downstream amplification primer 99-619 for SEQ 1763, in complement
atacctctgtgccattac

SEQ ID NO: 9629 - DNA, 19 bp, Homo Sapiens
  primer_bind 1..19: downstream amplification primer 99-6191 for SEQ 1764, in complement
gccatgttactccatgaag

SEQ ID NO: 9630 - DNA, 21 bp, Homo Sapiens
  primer_bind 1..21: downstream amplification primer 99-6193 for SEQ 1765, in complement
aggctttggttttttgctgtg

SEQ ID NO: 9631 - DNA, 21 bp, Homo Sapiens
  primer_bind 1..21: downstream amplification primer 99-621 for SEQ 1766, in complement
ctgctttctttaacagagaac

SEQ ID NO: 9632 - DNA, 21 bp, Homo Sapiens
  primer_bind 1..21: downstream amplification primer 99-6217 for SEQ 1767, in complement
actttctctagcttctcttgg

SEQ ID NO: 9633 - DNA, 21 bp, Homo Sapiens
  primer_bind 1..21: downstream amplification primer 99-622 for SEQ 1768, in complement
ctatcttcaaacataagaccc

SEQ ID NO: 9634 - DNA, 18 bp, Homo Sapiens
  primer_bind 1..18: downstream amplification primer 99-6253 for SEQ 1769, in complement
aaggcagaagagacagag

SEQ ID NO: 9635 - DNA, 18 bp, Homo Sapiens
  primer_bind 1..18: downstream amplification primer 99-6257 for SEQ 1770, in complement
tagttcacatcccagcac

SEQ ID NO: 9636 - DNA, 21 bp, Homo Sapiens
  primer_bind 1..21: downstream amplification primer 99-6261 for SEQ 1771, in complement
caagagaagaaaagggtgagg

SEQ ID NO: 9637 - DNA, 21 bp, Homo Sapiens
  primer_bind 1..21: downstream amplification primer 99-6278 for SEQ 1772, in complement
gcggttccatttcttttcttc

SEQ ID NO: 9638 - DNA, 21 bp, Homo Sapiens
  primer_bind 1..21: downstream amplification primer 99-6294 for SEQ 1773, in complement
cacaaagcaatggatcttcag

SEQ ID NO: 9639 - DNA, 18 bp, Homo Sapiens
  primer_bind 1..18: downstream amplification primer 99-6298 for SEQ 1774, in complement
actgtcctttctattccc

SEQ ID NO: 9640 - DNA, 19 bp, Homo Sapiens
  primer_bind 1..19: downstream amplification primer 99-6300 for SEQ 1775, in complement
caatcctatgaagtaggtc

SEQ ID NO: 9641 - DNA, 21 bp, Homo Sapiens
  primer_bind 1..21: downstream amplification primer 99-6310 for SEQ 1776, in complement
atgagtagtaatattctctcc

SEQ ID NO: 9642 - DNA, 18 bp, Homo Sapiens
  primer_bind 1..18: downstream amplification primer 99-632 for SEQ 1777, in complement
attcccaccactacttcc

SEQ ID NO: 9643 - DNA, 19 bp, Homo Sapiens
  primer_bind 1..19: downstream amplification primer 99-6327 for SEQ 1778, in complement
gtatatctgttgtgtactg

SEQ ID NO: 9644 - DNA, 21 bp, Homo Sapiens
  primer_bind 1..21: downstream amplification primer 99-6332 for SEQ 1779, in complement
ttattcctccctgcttgaacc

SEQ ID NO: 9645 - DNA, 18 bp, Homo Sapiens
  primer_bind 1..18: downstream amplification primer 99-6367 for SEQ 1780, in complement
gattcaccacttgctgac

SEQ ID NO: 9646 - DNA, 18 bp, Homo Sapiens
  primer_bind 1..18: downstream amplification primer 99-6368 for SEQ 1781, in complement
ttatatcatccctccccc

SEQ ID NO: 9647 - DNA, 18 bp, Homo Sapiens
  primer_bind 1..18: downstream amplification primer 99-6404 for SEQ 1782, in complement
tgtcactaacaaccaccc

SEQ ID NO: 9648 - DNA, 19 bp, Homo Sapiens
  primer_bind 1..19: downstream amplification primer 99-6409 for SEQ 1783, in complement
cttttccatctcccaacac

SEQ ID NO: 9649 - DNA, 20 bp, Homo Sapiens
  primer_bind 1..20: downstream amplification primer 99-6411 for SEQ 1784, in complement
ctgttccctctttgctcacc

SEQ ID NO: 9650 - DNA, 21 bp, Homo Sapiens
  primer_bind 1..21: downstream amplification primer 99-6413 for SEQ 1785, in complement
agagagtggaagagctgagag

SEQ ID NO: 9651 - DNA, 18 bp, Homo Sapiens
  primer_bind 1..18: downstream amplification primer 99-6415 for SEQ 1786, in complement
gaagaaccaaacccacag

SEQ ID NO: 9652 - DNA, 18 bp, Homo Sapiens
  primer_bind 1..18: downstream amplification primer 99-6421 for SEQ 1787, in complement
cctttcacacttgcagtc

SEQ ID NO: 9653 - DNA, 18 bp, Homo Sapiens
  primer_bind 1..18: downstream amplification primer 99-6423 for SEQ 1788, in complement
ttgggagttgggagattc

SEQ ID NO: 9654 - DNA, 19 bp, Homo Sapiens
  primer_bind 1..19: downstream amplification primer 99-6426 for SEQ 1789, in complement
agacctgctccactgatag

SEQ ID NO: 9655 - DNA, 18 bp, Homo Sapiens
  primer_bind 1..18: downstream amplification primer 99-6427 for SEQ 1790, in complement
tggtgaatagggactgtg

SEQ ID NO: 9656 - DNA, 20 bp, Homo Sapiens
  primer_bind 1..20: downstream amplification primer 99-6435 for SEQ 1791, in complement
gtctttttctcttttccacc

SEQ ID NO: 9657 - DNA, 21 bp, Homo Sapiens
  primer_bind 1..21: downstream amplification primer 99-6437 for SEQ 1792, in complement
tgccccttattctgctaaatg

SEQ ID NO: 9658 - DNA, 21 bp, Homo Sapiens
  primer_bind 1..21: downstream amplification primer 99-6440 for SEQ 1793, in complement
acaagttactcagtttttgcc

SEQ ID NO: 9659 - DNA, 21 bp, Homo Sapiens
  primer_bind 1..21: downstream amplification primer 99-6447 for SEQ 1794, in complement
acaaacaatagcaatgacaac

SEQ ID NO: 9660 - DNA, 18 bp, Homo Sapiens
  primer_bind 1..18: downstream amplification primer 99-6456 for SEQ 1795, in complement
ggagaccttggtaatcac

SEQ ID NO: 9661 - DNA, 19 bp, Homo Sapiens
  primer_bind 1..19: downstream amplification primer 99-6459 for SEQ 1796, in complement
cacaggaccctttagatac

SEQ ID NO: 9662 - DNA, 20 bp, Homo Sapiens
  primer_bind 1..20: downstream amplification primer 99-646 for SEQ 1797, in complement
tgaaaatttagggagattgg

SEQ ID NO: 9663 - DNA, 21 bp, Homo Sapiens
  primer_bind 1..21: downstream amplification primer 99-6463 for SEQ 1798, in complement
gtccatgcttcttcaaacatc

SEQ ID NO: 9664 - DNA, 18 bp, Homo Sapiens
  primer_bind 1..18: downstream amplification primer 99-6468 for SEQ 1799, in complement
acacgctttctgtggttg

SEQ ID NO: 9665 - DNA, 21 bp, Homo Sapiens
  primer_bind 1..21: downstream amplification primer 99-6478 for SEQ 1800, in complement
tagagagtggaactatcatgg

SEQ ID NO: 9666 - DNA, 21 bp, Homo Sapiens
  primer_bind 1..21: downstream amplification primer 99-6480 for SEQ 1801, in complement
tgggagcagcatcaattttac

SEQ ID NO: 9667 - DNA, 18 bp, Homo Sapiens
  primer_bind 1..18: downstream amplification primer 99-6489 for SEQ 1802, in complement
attttcccagcatcagtc

SEQ ID NO: 9668 - DNA, 21 bp, Homo Sapiens
  primer_bind 1..21: downstream amplification primer 99-649 for SEQ 1803, in complement
gtacagtaaaccccaagtacc

SEQ ID NO: 9669 - DNA, 20 bp, Homo Sapiens
  primer_bind 1..20: downstream amplification primer 99-6496 for SEQ 1804, in complement
tgttcaagttccccaagccc

SEQ ID NO: 9670 - DNA, 20 bp, Homo Sapiens
  primer_bind 1..20: downstream amplification primer 99-6511 for SEQ 1805, in complement
agggtaaacaaccgatactc

SEQ ID NO: 9671 - DNA, 19 bp, Homo Sapiens
  primer_bind 1..19: downstream amplification primer 99-6525 for SEQ 1806, in complement
gccatatattttctagccc

SEQ ID NO: 9672 - DNA, 21 bp, Homo Sapiens
  primer_bind 1..21: downstream amplification primer 99-6527 for SEQ 1807, in complement
gtttcccgtatcagtaaggag

SEQ ID NO: 9673 - DNA, 19 bp, Homo Sapiens
  primer_bind 1..19: downstream amplification primer 99-6529 for SEQ 1808, in complement
gtgccaattctttactttc

SEQ ID NO: 9674 - DNA, 21 bp, Homo Sapiens
  primer_bind 1..21: downstream amplification primer 99-6539 for SEQ 1809, in complement
agacaaatgagtttctgtgcc

SEQ ID NO: 9675 - DNA, 21 bp, Homo Sapiens
  primer_bind 1..21: downstream amplification primer 99-6557 for SEQ 1810, in complement
gtagtaagttttgaaatcagg

SEQ ID NO: 9676 - DNA, 19 bp, Homo Sapiens
  primer_bind 1..19: downstream amplification primer 99-658 for SEQ 1811, in complement
gttttccaacatacagagc

SEQ ID NO: 9677 - DNA, 19 bp, Homo Sapiens
  primer_bind 1..19: downstream amplification primer 99-6581 for SEQ 1812, in complement
tgaatgaaaaaagcctctg

SEQ ID NO: 9678 - DNA, 18 bp, Homo Sapiens
  primer_bind 1..18: downstream amplification primer 99-6586 for SEQ 1813, in complement
ccagtagtgtgtatgttc

SEQ ID NO: 9679 - DNA, 21 bp, Homo Sapiens
  primer_bind 1..21: downstream amplification primer 99-6588 for SEQ 1814, in complement
cctaccaataacccaaaatcc

SEQ ID NO: 9680 - DNA, 21 bp, Homo Sapiens
  primer_bind 1..21: downstream amplification primer 99-6595 for SEQ 1815, in complement
aatcttccataatcccactcc

SEQ ID NO: 9681 - DNA, 21 bp, Homo Sapiens
  primer_bind 1..21: downstream amplification primer 99-6609 for SEQ 1816, in complement
ttctatgggagatatggacac

SEQ ID NO: 9682 - DNA, 18 bp, Homo Sapiens
  primer_bind 1..18: downstream amplification primer 99-6612 for SEQ 1817, in complement
atgtgaggctgaagatgc

SEQ ID NO: 9683 - DNA, 21 bp, Homo Sapiens
  primer_bind 1..21: downstream amplification primer 99-6613 for SEQ 1818, in complement
tgtgagatgcagcatacagag

SEQ ID NO: 9684 - DNA, 18 bp, Homo Sapiens
  primer_bind 1..18: downstream amplification primer 99-6620 for SEQ 1819, in complement
ctctttgctggcatcttg

SEQ ID NO: 9685 - DNA, 21 bp, Homo Sapiens
  primer_bind 1..21: downstream amplification primer 99-6628 for SEQ 1820, in complement
agatatgtgcctttacaaatg

SEQ ID NO: 9686 - DNA, 20 bp, Homo Sapiens
  primer_bind 1..20: downstream amplification primer 99-6639 for SEQ 1821, in complement
gtacttcaggagaaatattg

SEQ ID NO: 9687 - DNA, 21 bp, Homo Sapiens
  primer_bind 1..21: downstream amplification primer 99-6640 for SEQ 1822, in complement
cagacgttaaaatgaagatag

SEQ ID NO: 9688 - DNA, 18 bp, Homo Sapiens
  primer_bind 1..18: downstream amplification primer 99-6646 for SEQ 1823, in complement
aactgctgaagcaacaac

SEQ ID NO: 9689 - DNA, 21 bp, Homo Sapiens
  primer_bind 1..21: downstream amplification primer 99-6667 for SEQ 1824, in complement
gcccgaatcttaatttctctc

SEQ ID NO: 9690 - DNA, 21 bp, Homo Sapiens
  primer_bind 1..21: downstream amplification primer 99-6672 for SEQ 1825, in complement
ttttatccttccttggtttac

SEQ ID NO: 9691 - DNA, 18 bp, Homo Sapiens
  primer_bind 1..18: downstream amplification primer 99-6675 for SEQ 1826, in complement
cacactattacactggac

SEQ ID NO: 9692 - DNA, 18 bp, Homo Sapiens
  primer_bind 1..18: downstream amplification primer 99-6688 for SEQ 1827, in complement
gtggacatcaataatcgg

SEQ ID NO: 9693 - DNA, 20 bp, Homo Sapiens
  primer_bind 1..20: downstream amplification primer 99-669 for SEQ 1828, in complement
cttttatacctcagacatac

SEQ ID NO: 9694 - DNA, 18 bp, Homo Sapiens
  primer_bind 1..18: downstream amplification primer 99-6697 for SEQ 1829, in complement
ttgatttaacccaccacc

SEQ ID NO: 9695 - DNA, 21 bp, Homo Sapiens
  primer_bind 1..21: downstream amplification primer 99-670 for SEQ 1830, in complement
ttagtcacacagttctatatc

SEQ ID NO: 9696 - DNA, 18 bp, Homo Sapiens
  primer_bind 1..18: downstream amplification primer 99-6705 for SEQ 1831, in complement
ggtgaagctggaaagagg

SEQ ID NO: 9697 - DNA, 20 bp, Homo Sapiens
  primer_bind 1..20: downstream amplification primer 99-6706 for SEQ 1832, in complement
catctttttgctctttgtgg

SEQ ID NO: 9698 - DNA, 18 bp, Homo Sapiens
  primer_bind 1..18: downstream amplification primer 99-6715 for SEQ 1833, in complement
gttaatttagcccttccc

SEQ ID NO: 9699 - DNA, 19 bp, Homo Sapiens
  primer_bind 1..19: downstream amplification primer 99-6726 for SEQ 1834, in complement
acagaccccttagttctcc

SEQ ID NO: 9700 - DNA, 21 bp, Homo Sapiens
  primer_bind 1..21: downstream amplification primer 99-6730 for SEQ 1835, in complement
tgaaaaagtagtgatgatagg

SEQ ID NO: 9701 - DNA, 21 bp, Homo Sapiens
  primer_bind 1..21: downstream amplification primer 99-6753 for SEQ 1836, in complement
taccgagagacaaataaaccc

SEQ ID NO: 9702 - DNA, 21 bp, Homo Sapiens
  primer_bind 1..21: downstream amplification primer 99-6757 for SEQ 1837, in complement
aattatattggacatactggg

SEQ ID NO: 9703 - DNA, 21 bp, Homo Sapiens
  primer_bind 1..21: downstream amplification primer 99-676 for SEQ 1838, in complement
aacaatctcattggactaaac

SEQ ID NO: 9704 - DNA, 21 bp, Homo Sapiens
  primer_bind 1..21: downstream amplification primer 99-6781 for SEQ 1839, in complement
ctctttatcgctatactcttc

SEQ ID NO: 9705 - DNA, 21 bp, Homo Sapiens
  primer_bind 1..21: downstream amplification primer 99-6790 for SEQ 1840, in complement
gcatcagttcatttcattgtc

SEQ ID NO: 9706 - DNA, 19 bp, Homo Sapiens
  primer_bind 1..19: downstream amplification primer 99-680 for SEQ 1841, in complement
ggcataatgacattggaac

SEQ ID NO: 9707 - DNA, 18 bp, Homo Sapiens
  primer_bind 1..18: downstream amplification primer 99-6804 for SEQ 1842, in complement
ctcttcacaaggttgttc

SEQ ID NO: 9708 - DNA, 18 bp, Homo Sapiens
  primer_bind 1..18: downstream amplification primer 99-6815 for SEQ 1843, in complement
gttgacggtagttcaaag

SEQ ID NO: 9709 - DNA, 20 bp, Homo Sapiens
  primer_bind 1..20: downstream amplification primer 99-6820 for SEQ 1844, in complement
gttttttttactgacctggg

SEQ ID NO: 9710 - DNA, 19 bp, Homo Sapiens
  primer_bind 1..19: downstream amplification primer 99-6832 for SEQ 1845, in complement
tgggtggtaggtgtgtttc

SEQ ID NO: 9711 - DNA, 21 bp, Homo Sapiens
  primer_bind 1..21: downstream amplification primer 99-6856 for SEQ 1846, in complement
aagaactatcaggtcaactgg

SEQ ID NO: 9712 - DNA, 18 bp, Homo Sapiens
  primer_bind 1..18: downstream amplification primer 99-6865 for SEQ 1847, in complement
ccattcccttattgacac

SEQ ID NO: 9713 - DNA, 21 bp, Homo Sapiens
  primer_bind 1..21: downstream amplification primer 99-6866 for SEQ 1848, in complement
actatttgaaagcaagtagcc

SEQ ID NO: 9714 - DNA, 18 bp, Homo Sapiens
  primer_bind 1..18: downstream amplification primer 99-6869 for SEQ 1849, in complement
gattcttctgggatgctg

SEQ ID NO: 9715 - DNA, 18 bp, Homo Sapiens
  primer_bind 1..18: downstream amplification primer 99-6876 for SEQ 1850, in complement
ttcttgagcccatcagag

SEQ ID NO: 9716 - DNA, 18 bp, Homo Sapiens
  primer_bind 1..18: downstream amplification primer 99-689 for SEQ 1851, in complement
ggacttagatagaccttg

SEQ ID NO: 9717 - DNA, 18 bp, Homo Sapiens
  primer_bind 1..18: downstream amplification primer 99-6893 for SEQ 1852, in complement
agtgttgttgttgaggag

SEQ ID NO: 9718 - DNA, 18 bp, Homo Sapiens
  primer_bind 1..18: downstream amplification primer 99-6895 for SEQ 1853, in complement
tgccttttttctgggtcg

SEQ ID NO: 9719 - DNA, 20 bp, Homo Sapiens
  primer_bind 1..20: downstream amplification primer 99-6938 for SEQ 1854, in complement
gccagttcacccctctttag

SEQ ID NO: 9720 - DNA, 21 bp, Homo Sapiens
  primer_bind 1..21: downstream amplification primer 99-694 for SEQ 1855, in complement
ttttactgtggtttagctttc

SEQ ID NO: 9721 - DNA, 21 bp, Homo Sapiens
  primer_bind 1..21: downstream amplification primer 99-6940 for SEQ 1856, in complement
accatccaatccgtttccaag

SEQ ID NO: 9722 - DNA, 18 bp, Homo Sapiens
  primer_bind 1..18: downstream amplification primer 99-6942 for SEQ 1857, in complement
ctggcataaagctcctac

SEQ ID NO: 9723 - DNA, 20 bp, Homo Sapiens
  primer_bind 1..20: downstream amplification primer 99-6951 for SEQ 1858, in complement
ttgtatctcactgagtacac

SEQ ID NO: 9724 - DNA, 19 bp, Homo Sapiens
  primer_bind 1..19: downstream amplification primer 99-6956 for SEQ 1859, in complement
gctatgaggacagaaaaag

SEQ ID NO: 9725 - DNA, 18 bp, Homo Sapiens
  primer_bind 1..18: downstream amplification primer 99-6957 for SEQ 1860, in complement
catcttctaggactttgg

SEQ ID NO: 9726 - DNA, 21 bp, Homo Sapiens
  primer_bind 1..21: downstream amplification primer 99-6960 for SEQ 1861, in complement
tcaaagacaggctcatctgac

SEQ ID NO: 9727 - DNA, 18 bp, Homo Sapiens
  primer_bind 1..18: downstream amplification primer 99-6962 for SEQ 1862, in complement
gacatagaccttacatcc

SEQ ID NO: 9728 - DNA, 21 bp, Homo Sapiens
  primer_bind 1..21: downstream amplification primer 99-6979 for SEQ 1863, in complement
tcccctttttttttttccttc

SEQ ID NO: 9729 - DNA, 18 bp, Homo Sapiens
  primer_bind 1..18: downstream amplification primer 99-6986 for SEQ 1864, in complement
ccccaaatctcttggttc

SEQ ID NO: 9730 - DNA, 21 bp, Homo Sapiens
  primer_bind 1..21: downstream amplification primer 99-6988 for SEQ 1865, in complement
gaaagcaaaacgaaaaagaag

SEQ ID NO: 9731 - DNA, 21 bp, Homo Sapiens
  primer_bind 1..21: downstream amplification primer 99-6989 for SEQ 1866, in complement
caagttgtgtgttcagtttcc

SEQ ID NO: 9732 - DNA, 18 bp, Homo Sapiens
  primer_bind 1..18: downstream amplification primer 99-6996 for SEQ 1867, in complement
ttactctgccacattgtc

SEQ ID NO: 9733 - DNA, 21 bp, Homo Sapiens
  primer_bind 1..21: downstream amplification primer 99-700 for SEQ 1868, in complement
ttaggttgtggagtaaggagg

SEQ ID NO: 9734 - DNA, 21 bp, Homo Sapiens
  primer_bind 1..21: downstream amplification primer 99-7000 for SEQ 1869, in complement
atccagggattttaccgatag

SEQ ID NO: 9735 - DNA, 19 bp, Homo Sapiens
  primer_bind 1..19: downstream amplification primer 99-7004 for SEQ 1870, in complement
cctcggctgttgttttatg

SEQ ID NO: 9736 - DNA, 21 bp, Homo Sapiens
  primer_bind 1..21: downstream amplification primer 99-7013 for SEQ 1871, in complement
cagatgtggtaaggggaatgg

SEQ ID NO: 9737 - DNA, 21 bp, Homo Sapiens
  primer_bind 1..21: downstream amplification primer 99-7024 for SEQ 1872, in complement
aaatctcaatgagccttcaac

SEQ ID NO: 9738 - DNA, 18 bp, Homo Sapiens
  primer_bind 1..18: downstream amplification primer 99-7025 for SEQ 1873, in complement
acggaaatgcctaacctg

SEQ ID NO: 9739 - DNA, 21 bp, Homo Sapiens
  primer_bind 1..21: downstream amplification primer 99-7026 for SEQ 1874, in complement
gcaacacaataggtagaccag

SEQ ID NO: 9740 - DNA, 20 bp, Homo Sapiens
  primer_bind 1..20: downstream amplification primer 99-7047 for SEQ 1875, in complement
aaaaggctctttaggtgctg

SEQ ID NO: 9741 - DNA, 20 bp, Homo Sapiens
  primer_bind 1..20: downstream amplification primer 99-7056 for SEQ 1876, in complement
atggagttagacagagctac

SEQ ID NO: 9742 - DNA, 19 bp, Homo Sapiens
  primer_bind 1..19: downstream amplification primer 99-708 for SEQ 1877, in complement
gaatcgagaagacataatg

SEQ ID NO: 9743 - DNA, 19 bp, Homo Sapiens
  primer_bind 1..19: downstream amplification primer 99-7084 for SEQ 1878, in complement
atggatcttatggtagaag

SEQ ID NO: 9744 - DNA, 20 bp, Homo Sapiens
  primer_bind 1..20: downstream amplification primer 99-7090 for SEQ 1879, in complement
aaccacaggcatattaacac

SEQ ID NO: 9745 - DNA, 21 bp, Homo Sapiens
  primer_bind 1..21: downstream amplification primer 99-7093 for SEQ 1880, in complement
aaaaatcccgtcccttaacac

SEQ ID NO: 9746 - DNA, 18 bp, Homo Sapiens
  primer_bind 1..18: downstream amplification primer 99-7098 for SEQ 1881, in complement
aactgctgttctcaggac

SEQ ID NO: 9747 - DNA, 19 bp, Homo Sapiens
  primer_bind 1..19: downstream amplification primer 99-7103 for SEQ 1882, in complement
ttcctgctctctcactctc

SEQ ID NO: 9748 - DNA, 18 bp, Homo Sapiens
  primer_bind 1..18: downstream amplification primer 99-7104 for SEQ 1883, in complement
tccaccaaccaaccaatc

SEQ ID NO: 9749 - DNA, 19 bp, Homo Sapiens
  primer_bind 1..19: downstream amplification primer 99-7107 for SEQ 1884, in complement
acagtgaggtggtggaaag

SEQ ID NO: 9750 - DNA, 18 bp, Homo Sapiens
  primer_bind 1..18: downstream amplification primer 99-7114 for SEQ 1885, in complement
gccgctctgaaatggtgc

SEQ ID NO: 9751 - DNA, 18 bp, Homo Sapiens
  primer_bind 1..18: downstream amplification primer 99-7119 for SEQ 1886, in complement
ttctaagacaggaagagg

SEQ ID NO: 9752 - DNA, 18 bp, Homo Sapiens
  primer_bind 1..18: downstream amplification primer 99-7129 for SEQ 1887, in complement
tgagggagtgattggaag

SEQ ID NO: 9753 - DNA, 20 bp, Homo Sapiens
  primer_bind 1..20: downstream amplification primer 99-7131 for SEQ 1888, in complement
gcctttgttaggtatatttg

SEQ ID NO: 9754 - DNA, 21 bp, Homo Sapiens
  primer_bind 1..21: downstream amplification primer 99-7136 for SEQ 1889, in complement
gaatacatcttgattttgtcc

SEQ ID NO: 9755 - DNA, 21 bp, Homo Sapiens
  primer_bind 1..21: downstream amplification primer 99-7137 for SEQ 1890, in complement
tacttcaaacccacataaaac

SEQ ID NO: 9756 - DNA, 20 bp, Homo Sapiens
  primer_bind 1..20: downstream amplification primer 99-7140 for SEQ 1891, in complement
gaaatgtgaatccattagcc

SEQ ID NO: 9757 - DNA, 21 bp, Homo Sapiens
  primer_bind 1..21: downstream amplification primer 99-7141 for SEQ 1892, in complement
ctcaagaaaatggggaagaac

SEQ ID NO: 9758 - DNA, 21 bp, Homo Sapiens
  primer_bind 1..21: downstream amplification primer 99-7144 for SEQ 1893, in complement
ggagtagggtaaaaataatac

SEQ ID NO: 9759 - DNA, 19 bp, Homo Sapiens
  primer_bind 1..19: downstream amplification primer 99-7148 for SEQ 1894, in complement
aggggtgtcacacagtaag

SEQ ID NO: 9760 - DNA, 21 bp, Homo Sapiens
  primer_bind 1..21: downstream amplification primer 99-7167 for SEQ 1895, in complement
agaaatacaaagtagggaggg

SEQ ID NO: 9761 - DNA, 19 bp, Homo Sapiens
  primer_bind 1..19: downstream amplification primer 99-7172 for SEQ 1896, in complement
catccttccctactttttc

SEQ ID NO: 9762 - DNA, 21 bp, Homo Sapiens
  primer_bind 1..21: downstream amplification primer 99-7177 for SEQ 1897, in complement
cccagaaattaactcaagtcc

SEQ ID NO: 9763 - DNA, 19 bp, Homo Sapiens
  primer_bind 1..19: downstream amplification primer 99-718 for SEQ 1898, in complement
agagagaaggagcaagcac

SEQ ID NO: 9764 - DNA, 21 bp, Homo Sapiens
  primer_bind 1..21: downstream amplification primer 99-7183 for SEQ 1899, in complement
aaaaaaccagcaaactgtgcc

SEQ ID NO: 9765 - DNA, 21 bp, Homo Sapiens
  primer_bind 1..21: downstream amplification primer 99-7193 for SEQ 1900, in complement
tgagaagtattgggagaggag

SEQ ID NO: 9766 - DNA, 21 bp, Homo Sapiens
  primer_bind 1..21: downstream amplification primer 99-72 for SEQ 1901, in complement
cacctctttttcttgcccacc

SEQ ID NO: 9767 - DNA, 21 bp, Homo Sapiens
  primer_bind 1..21: downstream amplification primer 99-7212 for SEQ 1902, in complement
gtcagtttaattgtcaaaacc

SEQ ID NO: 9768 - DNA, 18 bp, Homo Sapiens
  primer_bind 1..18: downstream amplification primer 99-7214 for SEQ 1903, in complement
gcaaaccatctcacttag

SEQ ID NO: 9769 - DNA, 18 bp, Homo Sapiens
  primer_bind 1..18: downstream amplification primer 99-7218 for SEQ 1904, in complement
tgggtgttggtactattc

SEQ ID NO: 9770 - DNA, 21 bp, Homo Sapiens
  primer_bind 1..21: downstream amplification primer 99-7234 for SEQ 1905, in complement
ggtccagcactaaaatgacac

SEQ ID NO: 9771 - DNA, 19 bp, Homo Sapiens
  primer_bind 1..19: downstream amplification primer 99-724 for SEQ 1906, in complement
cggaatatcagaggctgtc

SEQ ID NO: 9772 - DNA, 20 bp, Homo Sapiens
  primer_bind 1..20: downstream amplification primer 99-7252 for SEQ 1907, in complement
attctaagtttcccctgttg

SEQ ID NO: 9773 - DNA, 18 bp, Homo Sapiens
  primer_bind 1..18: downstream amplification primer 99-7274 for SEQ 1908, in complement
tgggtgattcgtatcttg

SEQ ID NO: 9774 - DNA, 21 bp, Homo Sapiens
  primer_bind 1..21: downstream amplification primer 99-7275 for SEQ 1909, in complement
attctggggcaatattccaag

SEQ ID NO: 9775 - DNA, 21 bp, Homo Sapiens
  primer_bind 1..21: downstream amplification primer 99-7276 for SEQ 1910, in complement
taatcctcctactttaatccc

SEQ ID NO: 9776 - DNA, 21 bp, Homo Sapiens
  primer_bind 1..21: downstream amplification primer 99-7293 for SEQ 1911, in complement
aaaaatgaaactgtcaaagcc

SEQ ID NO: 9777 - DNA, 21 bp, Homo Sapiens
  primer_bind 1..21: downstream amplification primer 99-73 for SEQ 1912, in complement
gggtaatgaacggcaaatcag

SEQ ID NO: 9778 - DNA, 19 bp, Homo Sapiens
  primer_bind 1..19: downstream amplification primer 99-7311 for SEQ 1913, in complement
tcccctttaaaatctttcc

SEQ ID NO: 9779 - DNA, 18 bp, Homo Sapiens
  primer_bind 1..18: downstream amplification primer 99-7312 for SEQ 1914, in complement
gaggacaggaagacatag

SEQ ID NO: 9780 - DNA, 21 bp, Homo Sapiens
  primer_bind 1..21: downstream amplification primer 99-7323 for SEQ 1915, in complement
tttctcacatctcactctcac

SEQ ID NO: 9781 - DNA, 19 bp, Homo Sapiens
  primer_bind 1..19: downstream amplification primer 99-7326 for SEQ 1916, in complement
ctctgattatagattagcc

SEQ ID NO: 9782 - DNA, 21 bp, Homo Sapiens
  primer_bind 1..21: downstream amplification primer 99-7334 for SEQ 1917, in complement
ttctccaacttactttccaac

SEQ ID NO: 9783 - DNA, 21 bp, Homo Sapiens
  primer_bind 1..21: downstream amplification primer 99-734 for SEQ 1918, in complement
aattgcttcttcatgcaacac

SEQ ID NO: 9784 - DNA, 19 bp, Homo Sapiens
  primer_bind 1..19: downstream amplification primer 99-7349 for SEQ 1919, in complement
gttcaggttctcacttagg

SEQ ID NO: 9785 - DNA, 18 bp, Homo Sapiens
  primer_bind 1..18: downstream amplification primer 99-7356 for SEQ 1920, in complement
ctaaaggtggagttggac

SEQ ID NO: 9786 - DNA, 20 bp, Homo Sapiens
  primer_bind 1..20: downstream amplification primer 99-7363 for SEQ 1921, in complement
ctcacgtacattctgtattg

SEQ ID NO: 9787 - DNA, 18 bp, Homo Sapiens
  primer_bind 1..18: downstream amplification primer 99-737 for SEQ 1922, in complement
aagcaaaaaggacagcac

SEQ ID NO: 9788 - DNA, 18 bp, Homo Sapiens
  primer_bind 1..18: downstream amplification primer 99-7373 for SEQ 1923, in complement
tgggtcataggatgtttc

SEQ ID NO: 9789 - DNA, 20 bp, Homo Sapiens
  primer_bind 1..20: downstream amplification primer 99-7374 for SEQ 1924, in complement
gcagtctttcttggtatgtg

SEQ ID NO: 9790 - DNA, 21 bp, Homo Sapiens
  primer_bind 1..21: downstream amplification primer 99-7375 for SEQ 1925, in complement
gaaatgaagatgttctggctg

SEQ ID NO: 9791 - DNA, 18 bp, Homo Sapiens
  primer_bind 1..18: downstream amplification primer 99-7376 for SEQ 1926, in complement
gtccacaaaccaactctg

SEQ ID NO: 9792 - DNA, 19 bp, Homo Sapiens
  primer_bind 1..19: downstream amplification primer 99-7380 for SEQ 1927, in complement
ccagcagtctggctttaac

SEQ ID NO: 9793 - DNA, 18 bp, Homo Sapiens
  primer_bind 1..18: downstream amplification primer 99-7387 for SEQ 1928, in complement
aaggattctgctgcttgg

SEQ ID NO: 9794 - DNA, 18 bp, Homo Sapiens
  primer_bind 1..18: downstream amplification primer 99-7391 for SEQ 1929, in complement
ggaagatgctatgcttgg

SEQ ID NO: 9795 - DNA, 20 bp, Homo Sapiens
  primer_bind 1..20: downstream amplification primer 99-7396 for SEQ 1930, in complement
ccacagaaatgtgtaaaatc

SEQ ID NO: 9796 - DNA, 21 bp, Homo Sapiens
  primer_bind 1..21: downstream amplification primer 99-7402 for SEQ 1931, in complement
tgcagagtataaacaaaacag

SEQ ID NO: 9797 - DNA, 19 bp, Homo Sapiens
  primer_bind 1..19: downstream amplification primer 99-7405 for SEQ 1932, in complement
tctaaaagttggggggagg

SEQ ID NO: 9798 - DNA, 20 bp, Homo Sapiens
  primer_bind 1..20: downstream amplification primer 99-7406 for SEQ 1933, in complement
agtgagtcaaaagttacagg

SEQ ID NO: 9799 - DNA, 21 bp, Homo Sapiens
  primer_bind 1..21: downstream amplification primer 99-7417 for SEQ 1934, in complement
tactagagaaaaaactggcac

SEQ ID NO: 9800 - DNA, 18 bp, Homo Sapiens
  primer_bind 1..18: downstream amplification primer 99-7429 for SEQ 1935, in complement
tgagagagaaatccatcc

SEQ ID NO: 9801 - DNA, 18 bp, Homo Sapiens
  primer_bind 1..18: downstream amplification primer 99-7447 for SEQ 1936, in complement
tgaataggcaagtcccag

SEQ ID NO: 9802 - DNA, 18 bp, Homo Sapiens
  primer_bind 1..18: downstream amplification primer 99-7453 for SEQ 1937, in complement
ccatctccaatctcaatc

SEQ ID NO: 9803 - DNA, 19 bp, Homo Sapiens
  primer_bind 1..19: downstream amplification primer 99-7454 for SEQ 1938, in complement
atttacagtggttagtgag

SEQ ID NO: 9804 - DNA, 19 bp, Homo Sapiens
  primer_bind 1..19: downstream amplification primer 99-747 for SEQ 1939, in complement
ttttctgctctaattcacc

SEQ ID NO: 9805 - DNA, 19 bp, Homo Sapiens
  primer_bind 1..19: downstream amplification primer 99-7475 for SEQ 1940, in complement
ctttactggcatgaagaac

SEQ ID NO: 9806 - DNA, 18 bp, Homo Sapiens
  primer_bind 1..18: downstream amplification primer 99-7480 for SEQ 1941, in complement
caccatctccttccattc

SEQ ID NO: 9807 - DNA, 21 bp, Homo Sapiens
  primer_bind 1..21: downstream amplification primer 99-7492 for SEQ 1942, in complement
tacttcatattcaaaaggggc

SEQ ID NO: 9808 - DNA, 21 bp, Homo Sapiens
  primer_bind 1..21: downstream amplification primer 99-7493 for SEQ 1943, in complement
acttgctgagtgcctactctg

SEQ ID NO: 9809 - DNA, 21 bp, Homo Sapiens
  primer_bind 1..21: downstream amplification primer 99-7502 for SEQ 1944, in complement
cttctctgattcactctttgg

SEQ ID NO: 9810 - DNA, 21 bp, Homo Sapiens
  primer_bind 1..21: downstream amplification primer 99-7504 for SEQ 1945, in complement
ctaaataccctcaaggcacac

SEQ ID NO: 9811 - DNA, 20 bp, Homo Sapiens
  primer_bind 1..20: downstream amplification primer 99-7520 for SEQ 1946, in complement
cacaaccaatcacaaatttc

SEQ ID NO: 9812 - DNA, 21 bp, Homo Sapiens
  primer_bind 1..21: downstream amplification primer 99-7524 for SEQ 1947, in complement
tagtgcatggcaatctttatc

SEQ ID NO: 9813 - DNA, 18 bp, Homo Sapiens
  primer_bind 1..18: downstream amplification primer 99-7543 for SEQ 1948, in complement
ttgaaactggagggaagg

SEQ ID NO: 9814 - DNA, 18 bp, Homo Sapiens
  primer_bind 1..18: downstream amplification primer 99-755 for SEQ 1949, in complement
agtagattgtgagatggg

SEQ ID NO: 9815 - DNA, 21 bp, Homo Sapiens
  primer_bind 1..21: downstream amplification primer 99-7598 for SEQ 1950, in complement
gacagcatctaaacaataccc

SEQ ID NO: 9816 - DNA, 21 bp, Homo Sapiens
  primer_bind 1..21: downstream amplification primer 99-760 for SEQ 1951, in complement
tattggaatatcaactctggg

SEQ ID NO: 9817 - DNA, 19 bp, Homo Sapiens
  primer_bind 1..19: downstream amplification primer 99-7604 for SEQ 1952, in complement
agggcaagtcagtagtcac

SEQ ID NO: 9818 - DNA, 21 bp, Homo Sapiens
  primer_bind 1..21: downstream amplification primer 99-7605 for SEQ 1953, in complement
caggtgcctctttcttgcttc

SEQ ID NO: 9819 - DNA, 19 bp, Homo Sapiens
  primer_bind 1..19: downstream amplification primer 99-7608 for SEQ 1954, in complement
gtgcatttgtattagccag

SEQ ID NO: 9820 - DNA, 19 bp, Homo Sapiens
  primer_bind 1..19: downstream amplification primer 99-7610 for SEQ 1955, in complement
aattctactgcttactctc

SEQ ID NO: 9821 - DNA, 21 bp, Homo Sapiens
  primer_bind 1..21: downstream amplification primer 99-7611 for SEQ 1956, in complement
actttttgctgtatcttcacc

SEQ ID NO: 9822 - DNA, 19 bp, Homo Sapiens
  primer_bind 1..19: downstream amplification primer 99-7614 for SEQ 1957, in complement
cttttacaccccactcttg

SEQ ID NO: 9823 - DNA, 21 bp, Homo Sapiens
  primer_bind 1..21: downstream amplification primer 99-763 for SEQ 1958, in complement
gtttgtgtttgaaagtttcag

SEQ ID NO: 9824 - DNA, 20 bp, Homo Sapiens
  primer_bind 1..20: downstream amplification primer 99-7642 for SEQ 1959, in complement
tgagcaacagcaaaaacaac

SEQ ID NO: 9825 - DNA, 21 bp, Homo Sapiens
  primer_bind 1..21: downstream amplification primer 99-7643 for SEQ 1960, in complement
attttgttgccctgtgttgtg

SEQ ID NO: 9826 - DNA, 21 bp, Homo Sapiens
  primer_bind 1..21: downstream amplification primer 99-7650 for SEQ 1961, in complement
tcacagcatttggatgttgag

SEQ ID NO: 9827 - DNA, 18 bp, Homo Sapiens
  primer_bind 1..18: downstream amplification primer 99-7671 for SEQ 1962, in complement
agcacttacctccttctc

SEQ ID NO: 9828 - DNA, 21 bp, Homo Sapiens
  primer_bind 1..21: downstream amplification primer 99-7677 for SEQ 1963, in complement
atacccaagcacctttccttc

SEQ ID NO: 9829 - DNA, 21 bp, Homo Sapiens
  primer_bind 1..21: downstream amplification primer 99-7688 for SEQ 1964, in complement
ctcacaaactctgataagtag

SEQ ID NO: 9830 - DNA, 21 bp, Homo Sapiens
  primer_bind 1..21: downstream amplification primer 99-7692 for SEQ 1965, in complement
agaatataggagattgggaag

SEQ ID NO: 9831 - DNA, 18 bp, Homo Sapiens
  primer_bind 1..18: downstream amplification primer 99-77 for SEQ 1966, in complement
tgcagagaggcaaaaagc

SEQ ID NO: 9832 - DNA, 20 bp, Homo Sapiens
  primer_bind 1..20: downstream amplification primer 99-7706 for SEQ 1967, in complement
cttctagctcaagttcttgg

SEQ ID NO: 9833 - DNA, 21 bp, Homo Sapiens
  primer_bind 1..21: downstream amplification primer 99-771 for SEQ 1968, in complement
ggatgggagattaaagatttg

SEQ ID NO: 9834 - DNA, 21 bp, Homo Sapiens
  primer_bind 1..21: downstream amplification primer 99-7710 for SEQ 1969, in complement
tgtttgaagttttacgagttg

SEQ ID NO: 9835 - DNA, 21 bp, Homo Sapiens
  primer_bind 1..21: downstream amplification primer 99-7712 for SEQ 1970, in complement
gtgctccttccatatatcttc

SEQ ID NO: 9836 - DNA, 20 bp, Homo Sapiens
  primer_bind 1..20: downstream amplification primer 99-7721 for SEQ 1971, in complement
gctaaatctgaccctaaaac

SEQ ID NO: 9837 - DNA, 18 bp, Homo Sapiens
  primer_bind 1..18: downstream amplification primer 99-7727 for SEQ 1972, in complement
tgtaggatttggagcatc

SEQ ID NO: 9838 - DNA, 21 bp, Homo Sapiens
  primer_bind 1..21: downstream amplification primer 99-7728 for SEQ 1973, in complement
tttcagagttgtgttttcccc

SEQ ID NO: 9839 - DNA, 19 bp, Homo Sapiens
  primer_bind 1..19: downstream amplification primer 99-7732 for SEQ 1974, in complement
gagactagaaactcttctg

SEQ ID NO: 9840 - DNA, 20 bp, Homo Sapiens
  primer_bind 1..20: downstream amplification primer 99-7737 for SEQ 1975, in complement
ctgttcttctcatttgtttg

SEQ ID NO: 9841 - DNA, 21 bp, Homo Sapiens
  primer_bind 1..21: downstream amplification primer 99-7744 for SEQ 1976, in complement
atcttttcccccaaaaaacac

SEQ ID NO: 9842 - DNA, 19 bp, Homo Sapiens
  primer_bind 1..19: downstream amplification primer 99-7745 for SEQ 1977, in complement
ggcacctactagcacattc

SEQ ID NO: 9843 - DNA, 18 bp, Homo Sapiens
  primer_bind 1..18: downstream amplification primer 99-7749 for SEQ 1978, in complement
ctttgttagggtgtgtag

SEQ ID NO: 9844 - DNA, 19 bp, Homo Sapiens
  primer_bind 1..19: downstream amplification primer 99-7751 for SEQ 1979, in complement
taggatctgaaattgtctg

SEQ ID NO: 9845 - DNA, 18 bp, Homo Sapiens
  primer_bind 1..18: downstream amplification primer 99-7753 for SEQ 1980, in complement
tgctttatgatgaggctg

SEQ ID NO: 9846 - DNA, 20 bp, Homo Sapiens
  primer_bind 1..20: downstream amplification primer 99-7754 for SEQ 1981, in complement
ctgaaatgctatgcaaactg

SEQ ID NO: 9847 - DNA, 21 bp, Homo Sapiens
  primer_bind 1..21: downstream amplification primer 99-7759 for SEQ 1982, in complement
tctatcttttgaaaacctctg

SEQ ID NO: 9848 - DNA, 20 bp, Homo Sapiens
  primer_bind 1..20: downstream amplification primer 99-7762 for SEQ 1983, in complement
acatggaggaagggatcagg

SEQ ID NO: 9849 - DNA, 21 bp, Homo Sapiens
  primer_bind 1..21: downstream amplification primer 99-7764 for SEQ 1984, in complement
gtatttttttcccctcgtacc

SEQ ID NO: 9850 - DNA, 18 bp, Homo Sapiens
  primer_bind 1..18: downstream amplification primer 99-7775 for SEQ 1985, in complement
ctatcagtgtgtcaggtg

SEQ ID NO: 9851 - DNA, 18 bp, Homo Sapiens
  primer_bind 1..18: downstream amplification primer 99-7784 for SEQ 1986, in complement
tttctcaatctccccctc

SEQ ID NO: 9852 - DNA, 21 bp, Homo Sapiens
  primer_bind 1..21: downstream amplification primer 99-7789 for SEQ 1987, in complement
cttaaaaatgattctgggggg

SEQ ID NO: 9853 - DNA, 19 bp, Homo Sapiens
  primer_bind 1..19: downstream amplification primer 99-7792 for SEQ 1988, in complement
caaaaaggagggcaaaaac

SEQ ID NO: 9854 - DNA, 20 bp, Homo Sapiens
  primer_bind 1..20: downstream amplification primer 99-7796 for SEQ 1989, in complement
taaaaaattctctgccagcc

SEQ ID NO: 9855 - DNA, 20 bp, Homo Sapiens
  primer_bind 1..20: downstream amplification primer 99-7803 for SEQ 1990, in complement
ttttgttttgtgtctccgtg

SEQ ID NO: 9856 - DNA, 21 bp, Homo Sapiens
  primer_bind 1..21: downstream amplification primer 99-781 for SEQ 1991, in complement
aaaagtccatcaacactaccc

SEQ ID NO: 9857 - DNA, 20 bp, Homo Sapiens
  primer_bind 1..20: downstream amplification primer 99-7840 for SEQ 1992, in complement
ctgcttaaaagaacaaatgg

SEQ ID NO: 9858 - DNA, 21 bp, Homo Sapiens
  primer_bind 1..21: downstream amplification primer 99-785 for SEQ 1993, in complement
tatttaagacattccaaggac

SEQ ID NO: 9859 - DNA, 21 bp, Homo Sapiens
  primer_bind 1..21: downstream amplification primer 99-7868 for SEQ 1994, in complement
aagtccaagtcctcgtaaatc

SEQ ID NO: 9860 - DNA, 19 bp, Homo Sapiens
  primer_bind 1..19: downstream amplification primer 99-7869 for SEQ 1995, in complement
ttttccatgtgattcagtg

SEQ ID NO: 9861 - DNA, 21 bp, Homo Sapiens
  primer_bind 1..21: downstream amplification primer 99-7870 for SEQ 1996, in complement
attgaggataaaagaaagggg

SEQ ID NO: 9862 - DNA, 21 bp, Homo Sapiens
  primer_bind 1..21: downstream amplification primer 99-7877 for SEQ 1997, in complement
gatctacatttcccttaattg

SEQ ID NO: 9863 - DNA, 18 bp, Homo Sapiens
  primer_bind 1..18: downstream amplification primer 99-7882 for SEQ 1998, in complement
gtatagaagaggctcctg

SEQ ID NO: 9864 - DNA, 21 bp, Homo Sapiens
  primer_bind 1..21: downstream amplification primer 99-7883 for SEQ 1999, in complement
tcatcaggagaagttagttgg

SEQ ID NO: 9865 - DNA, 18 bp, Homo Sapiens
  primer_bind 1..18: downstream amplification primer 99-7884 for SEQ 2000, in complement
cagccaacttttgcatcc

SEQ ID NO: 9866 - DNA, 20 bp, Homo Sapiens
  primer_bind 1..20: downstream amplification primer 99-7893 for SEQ 2001, in complement
gtgaaaaaaccatacctaag

SEQ ID NO: 9867 - DNA, 20 bp, Homo Sapiens
  primer_bind 1..20: downstream amplification primer 99-7898 for SEQ 2002, in complement
gtattttgttactgtgcagc

SEQ ID NO: 9868 - DNA, 19 bp, Homo Sapiens
  primer_bind 1..19: downstream amplification primer 99-7900 for SEQ 2003, in complement
aagagggcttcttgacctg

SEQ ID NO: 9869 - DNA, 19 bp, Homo Sapiens
  primer_bind 1..19: downstream amplification primer 99-791 for SEQ 2004, in complement
taggaggaaaataagaagc

SEQ ID NO: 9870 - DNA, 19 bp, Homo Sapiens
  primer_bind 1..19: downstream amplification primer 99-7917 for SEQ 2005, in complement
gctttactaacagatgcac

SEQ ID NO: 9871 - DNA, 19 bp, Homo Sapiens
  primer_bind 1..19: downstream amplification primer 99-794 for SEQ 2006, in complement
tagagccttttaaactgac

SEQ ID NO: 9872 - DNA, 19 bp, Homo Sapiens
  primer_bind 1..19: downstream amplification primer 99-7949 for SEQ 2007, in complement
cacctattgtggtaaattc

SEQ ID NO: 9873 - DNA, 19 bp, Homo Sapiens
  primer_bind 1..19: downstream amplification primer 99-795 for SEQ 2008, in complement
cactgagattttgaagttg

SEQ ID NO: 9874 - DNA, 19 bp, Homo Sapiens
  primer_bind 1..19: downstream amplification primer 99-7967 for SEQ 2009, in complement
caacacaatgtttcactgg

SEQ ID NO: 9875 - DNA, 21 bp, Homo Sapiens
  primer_bind 1..21: downstream amplification primer 99-797 for SEQ 2010, in complement
gtactatcattgtctatcacc

SEQ ID NO: 9876 - DNA, 20 bp, Homo Sapiens
  primer_bind 1..20: downstream amplification primer 99-7985 for SEQ 2011, in complement
ctctttactttccatctcac

SEQ ID NO: 9877 - DNA, 21 bp, Homo Sapiens
  primer_bind 1..21: downstream amplification primer 99-7988 for SEQ 2012, in complement
ttcaccatacagctccattcc

SEQ ID NO: 9878 - DNA, 20 bp, Homo Sapiens
  primer_bind 1..20: downstream amplification primer 99-8002 for SEQ 2013, in complement
aggcacagcgaagtccattg

SEQ ID NO: 9879 - DNA, 20 bp, Homo Sapiens
  primer_bind 1..20: downstream amplification primer 99-8010 for SEQ 2014, in complement
ctgttttgcatctgcatttg

SEQ ID NO: 9880 - DNA, 19 bp, Homo Sapiens
  primer_bind 1..19: downstream amplification primer 99-8012 for SEQ 2015, in complement
tcctgagcttgtgtgactg

SEQ ID NO: 9881 - DNA, 18 bp, Homo Sapiens
  primer_bind 1..18: downstream amplification primer 99-8013 for SEQ 2016, in complement
gcctaacttccctctttg

SEQ ID NO: 9882 - DNA, 20 bp, Homo Sapiens
  primer_bind 1..20: downstream amplification primer 99-8016 for SEQ 2017, in complement
ctagcgaagctaccttctcc

SEQ ID NO: 9883 - DNA, 21 bp, Homo Sapiens
  primer_bind 1..21: downstream amplification primer 99-8025 for SEQ 2018, in complement
gggtgtatattttagtgtttg

SEQ ID NO: 9884 - DNA, 18 bp, Homo Sapiens
  primer_bind 1..18: downstream amplification primer 99-8027 for SEQ 2019, in complement
ccaagaaagggatttcac

SEQ ID NO: 9885 - DNA, 21 bp, Homo Sapiens
  primer_bind 1..21: downstream amplification primer 99-8028 for SEQ 2020, in complement
cgttttcttactaccactatc

SEQ ID NO: 9886 - DNA, 21 bp, Homo Sapiens
  primer_bind 1..21: downstream amplification primer 99-8030 for SEQ 2021, in complement
aaatggtctctcttcaactgg

SEQ ID NO: 9887 - DNA, 21 bp, Homo Sapiens
  primer_bind 1..21: downstream amplification primer 99-8046 for SEQ 2022, in complement
cagacagcacaactaaaaaac

SEQ ID NO: 9888 - DNA, 19 bp, Homo Sapiens
  primer_bind 1..19: downstream amplification primer 99-8051 for SEQ 2023, in complement
gaagtggatgaaccttaac

SEQ ID NO: 9889 - DNA, 18 bp, Homo Sapiens
  primer_bind 1..18: downstream amplification primer 99-806 for SEQ 2024, in complement
cagacgcctagatttacc

SEQ ID NO: 9890 - DNA, 21 bp, Homo Sapiens
  primer_bind 1..21: downstream amplification primer 99-8063 for SEQ 2025, in complement
gtaattatccagactttctac

SEQ ID NO: 9891 - DNA, 18 bp, Homo Sapiens
  primer_bind 1..18: downstream amplification primer 99-8067 for SEQ 2026, in complement
agtaagtggcagcgtaac

SEQ ID NO: 9892 - DNA, 18 bp, Homo Sapiens
  primer_bind 1..18: downstream amplification primer 99-8068 for SEQ 2027, in complement
aaggtggctgcattttac

SEQ ID NO: 9893 - DNA, 18 bp, Homo Sapiens
  primer_bind 1..18: downstream amplification primer 99-8081 for SEQ 2028, in complement
gtctgtttgtggatgatg

SEQ ID NO: 9894 - DNA, 20 bp, Homo Sapiens
  primer_bind 1..20: downstream amplification primer 99-8088 for SEQ 2029, in complement
gtgtctcaacagtttttttc

SEQ ID NO: 9895 - DNA, 21 bp, Homo Sapiens
  primer_bind 1..21: downstream amplification primer 99-8089 for SEQ 2030, in complement
gcttttggaaatgaggagttg

SEQ ID NO: 9896 - DNA, 21 bp, Homo Sapiens
  primer_bind 1..21: downstream amplification primer 99-8095 for SEQ 2031, in complement
tgggaccaaagaactcataac

SEQ ID NO: 9897 - DNA, 18 bp, Homo Sapiens
  primer_bind 1..18: downstream amplification primer 99-81 for SEQ 2032, in complement
gtcgtctgaagaactttg

SEQ ID NO: 9898 - DNA, 20 bp, Homo Sapiens
  primer_bind 1..20: downstream amplification primer 99-810 for SEQ 2033, in complement
acggtaattctcttccaatc

SEQ ID NO: 9899 - DNA, 18 bp, Homo Sapiens
  primer_bind 1..18: downstream amplification primer 99-8102 for SEQ 2034, in complement
gctaagaactgaaaggag

SEQ ID NO: 9900 - DNA, 21 bp, Homo Sapiens
  primer_bind 1..21: downstream amplification primer 99-8120 for SEQ 2035, in complement
agataaaggtgtggggaagag

SEQ ID NO: 9901 - DNA, 19 bp, Homo Sapiens
  primer_bind 1..19: downstream amplification primer 99-8128 for SEQ 2036, in complement
caagtttagcacaaatccc

SEQ ID NO: 9902 - DNA, 19 bp, Homo Sapiens
  primer_bind 1..19: downstream amplification primer 99-8141 for SEQ 2037, in complement
tttaatcttcaccacaacc

SEQ ID NO: 9903 - DNA, 20 bp, Homo Sapiens
  primer_bind 1..20: downstream amplification primer 99-8161 for SEQ 2038, in complement
gcagtctttcttggtatgtg

SEQ ID NO: 9904 - DNA, 21 bp, Homo Sapiens
  primer_bind 1..21: downstream amplification primer 99-8162 for SEQ 2039, in complement
gaaatgaagatgttctggctg

SEQ ID NO: 9905 - DNA, 18 bp, Homo Sapiens
  primer_bind 1..18: downstream amplification primer 99-8164 for SEQ 2040, in complement
gtccacaaaccaactctg

SEQ ID NO: 9906 - DNA, 21 bp, Homo Sapiens
  primer_bind 1..21: downstream amplification primer 99-8170 for SEQ 2041, in complement
aaggaaatccgtaaagaaaag

SEQ ID NO: 9907 - DNA, 21 bp, Homo Sapiens
  primer_bind 1..21: downstream amplification primer 99-8173 for SEQ 2042, in complement
acttctatgttgttcaagccc

SEQ ID NO: 9908 - DNA, 20 bp, Homo Sapiens
  primer_bind 1..20: downstream amplification primer 99-8181 for SEQ 2043, in complement
ccacagaaatgtgtaaaatc

SEQ ID NO: 9909 - DNA, 21 bp, Homo Sapiens
  primer_bind 1..21: downstream amplification primer 99-8186 for SEQ 2044, in complement
tgcagagtataaacaaaacag

SEQ ID NO: 9910 - DNA, 20 bp, Homo Sapiens
  primer_bind 1..20: downstream amplification primer 99-8188 for SEQ 2045, in complement
cccataccactttcattttc

SEQ ID NO: 9911 - DNA, 18 bp, Homo Sapiens
  primer_bind 1..18: downstream amplification primer 99-8192 for SEQ 2046, in complement
gccctttggaaagacttg

SEQ ID NO: 9912 - DNA, 21 bp, Homo Sapiens
  primer_bind 1..21: downstream amplification primer 99-8219 for SEQ 2047, in complement
ggcaaactagaaataaaaagg

SEQ ID NO: 9913 - DNA, 18 bp, Homo Sapiens
  primer_bind 1..18: downstream amplification primer 99-8245 for SEQ 2048, in complement
agataatgcccagtatcc

SEQ ID NO: 9914 - DNA, 19 bp, Homo Sapiens
  primer_bind 1..19: downstream amplification primer 99-8255 for SEQ 2049, in complement
gttaatgcttatggtgatg

SEQ ID NO: 9915 - DNA, 21 bp, Homo Sapiens
  primer_bind 1..21: downstream amplification primer 99-8256 for SEQ 2050, in complement
gtaatacaggttcacaatctc

SEQ ID NO: 9916 - DNA, 18 bp, Homo Sapiens
  primer_bind 1..18: downstream amplification primer 99-8266 for SEQ 2051, in complement
gcactgggatatagatag

SEQ ID NO: 9917 - DNA, 21 bp, Homo Sapiens
  primer_bind 1..21: downstream amplification primer 99-827 for SEQ 2052, in complement
tggttattcctaaaaagactg

SEQ ID NO: 9918 - DNA, 18 bp, Homo Sapiens
  primer_bind 1..18: downstream amplification primer 99-8272 for SEQ 2053, in complement
agagtttgacagatgggg

SEQ ID NO: 9919 - DNA, 20 bp, Homo Sapiens
  primer_bind 1..20: downstream amplification primer 99-8276 for SEQ 2054, in complement
ttggatttctgctttgtgtc

SEQ ID NO: 9920 - DNA, 19 bp, Homo Sapiens
  primer_bind 1..19: downstream amplification primer 99-8278 for SEQ 2055, in complement
ccctttctctttaagagtg

SEQ ID NO: 9921 - DNA, 19 bp, Homo Sapiens
  primer_bind 1..19: downstream amplification primer 99-8279 for SEQ 2056, in complement
ctctggcattaaagatagg

SEQ ID NO: 9922 - DNA, 21 bp, Homo Sapiens
  primer_bind 1..21: downstream amplification primer 99-828 for SEQ 2057, in complement
tcaccacaggataaaataaac

SEQ ID NO: 9923 - DNA, 20 bp, Homo Sapiens
  primer_bind 1..20: downstream amplification primer 99-8287 for SEQ 2058, in complement
gcaggagcaattaaatcagg

SEQ ID NO: 9924 - DNA, 20 bp, Homo Sapiens
  primer_bind 1..20: downstream amplification primer 99-8289 for SEQ 2059, in complement
gatataaaggagatacacag

SEQ ID NO: 9925 - DNA, 21 bp, Homo Sapiens
  primer_bind 1..21: downstream amplification primer 99-8290 for SEQ 2060, in complement
atatccatcagtgctggggtc

SEQ ID NO: 9926 - DNA, 21 bp, Homo Sapiens
  primer_bind 1..21: downstream amplification primer 99-8292 for SEQ 2061, in complement
atccaacacaagcaccctctg

SEQ ID NO: 9927 - DNA, 18 bp, Homo Sapiens
  primer_bind 1..18: downstream amplification primer 99-8294 for SEQ 2062, in complement
gcccagcctattcatgtg

SEQ ID NO: 9928 - DNA, 20 bp, Homo Sapiens
  primer_bind 1..20: downstream amplification primer 99-8308 for SEQ 2063, in complement
atatgggtaaaagtggaagg

SEQ ID NO: 9929 - DNA, 18 bp, Homo Sapiens
  primer_bind 1..18: downstream amplification primer 99-8313 for SEQ 2064, in complement
ggattatgggagaatcag

SEQ ID NO: 9930 - DNA, 21 bp, Homo Sapiens
  primer_bind 1..21: downstream amplification primer 99-8318 for SEQ 2065, in complement
agactctattcaagcatcacc

SEQ ID NO: 9931 - DNA, 21 bp, Homo Sapiens
  primer_bind 1..21: downstream amplification primer 99-8328 for SEQ 2066, in complement
aatgacggaatattgagcaac

SEQ ID NO: 9932 - DNA, 18 bp, Homo Sapiens
  primer_bind 1..18: downstream amplification primer 99-8338 for SEQ 2067, in complement
caccacagtatccatctc

SEQ ID NO: 9933 - DNA, 20 bp, Homo Sapiens
  primer_bind 1..20: downstream amplification primer 99-8340 for SEQ 2068, in complement
cactgtgttatcatggatag

SEQ ID NO: 9934 - DNA, 21 bp, Homo Sapiens
  primer_bind 1..21: downstream amplification primer 99-8341 for SEQ 2069, in complement
ggaaatgaaacaaaactgtgc

SEQ ID NO: 9935 - DNA, 18 bp, Homo Sapiens
  primer_bind 1..18: downstream amplification primer 99-8342 for SEQ 2070, in complement
tgatgacaacaacactcc

SEQ ID NO: 9936 - DNA, 21 bp, Homo Sapiens
  primer_bind 1..21: downstream amplification primer 99-8353 for SEQ 2071, in complement
tagacatccctcaatgcctac

SEQ ID NO: 9937 - DNA, 21 bp, Homo Sapiens
  primer_bind 1..21: downstream amplification primer 99-8360 for SEQ 2072, in complement
ttcttcctacagtctaacctc

SEQ ID NO: 9938 - DNA, 21 bp, Homo Sapiens
  primer_bind 1..21: downstream amplification primer 99-8361 for SEQ 2073, in complement
tgctactgcttctcctcatcc

SEQ ID NO: 9939 - DNA, 19 bp, Homo Sapiens
  primer_bind 1..19: downstream amplification primer 99-8367 for SEQ 2074, in complement
gccaagctgggtcttaaag

SEQ ID NO: 9940 - DNA, 19 bp, Homo Sapiens
  primer_bind 1..19: downstream amplification primer 99-8369 for SEQ 2075, in complement
gaaaagagcaaagcaagag

SEQ ID NO: 9941 - DNA, 19 bp, Homo Sapiens
  primer_bind 1..19: downstream amplification primer 99-8377 for SEQ 2076, in complement
cacttattatgccctagac

SEQ ID NO: 9942 - DNA, 19 bp, Homo Sapiens
  primer_bind 1..19: downstream amplification primer 99-8378 for SEQ 2077, in complement
cactccctattcatttttc

SEQ ID NO: 9943 - DNA, 18 bp, Homo Sapiens
  primer_bind 1..18: downstream amplification primer 99-8379 for SEQ 2078, in complement
gcccttgctttctacttg

SEQ ID NO: 9944 - DNA, 19 bp, Homo Sapiens
  primer_bind 1..19: downstream amplification primer 99-8381 for SEQ 2079, in complement
gtacacaactaaactcatc

SEQ ID NO: 9945 - DNA, 18 bp, Homo Sapiens
  primer_bind 1..18: downstream amplification primer 99-8383 for SEQ 2080, in complement
acttagccgcaaatgtcc

SEQ ID NO: 9946 - DNA, 21 bp, Homo Sapiens
  primer_bind 1..21: downstream amplification primer 99-8385 for SEQ 2081, in complement
aagatattttgaagcacctac

SEQ ID NO: 9947 - DNA, 21 bp, Homo Sapiens
  primer_bind 1..21: downstream amplification primer 99-840 for SEQ 2082, in complement
ggttgtgttaatgaaagaaag

SEQ ID NO: 9948 - DNA, 21 bp, Homo Sapiens
  primer_bind 1..21: downstream amplification primer 99-8402 for SEQ 2083, in complement
acattcagcatgaactctcag

SEQ ID NO: 9949 - DNA, 21 bp, Homo Sapiens
  primer_bind 1..21: downstream amplification primer 99-8414 for SEQ 2084, in complement
ttaagcagcaaactgggtttc

SEQ ID NO: 9950 - DNA, 21 bp, Homo Sapiens
  primer_bind 1..21: downstream amplification primer 99-8441 for SEQ 2085, in complement
acaaattagcaatccaaacag

SEQ ID NO: 9951 - DNA, 20 bp, Homo Sapiens
  primer_bind 1..20: downstream amplification primer 99-8442 for SEQ 2086, in complement
tgcttatttacttctcaggg

SEQ ID NO: 9952 - DNA, 21 bp, Homo Sapiens
  primer_bind 1..21: downstream amplification primer 99-8453 for SEQ 2087, in complement
gtcttgcagtcaaattcagcc

SEQ ID NO: 9953 - DNA, 21 bp, Homo Sapiens
  primer_bind 1..21: downstream amplification primer 99-8454 for SEQ 2088, in complement
gtacacatgcctaattctatc

SEQ ID NO: 9954 - DNA, 21 bp, Homo Sapiens
  primer_bind 1..21: downstream amplification primer 99-8456 for SEQ 2089, in complement
gttttaatgtttggtcttcag

SEQ ID NO: 9955 - DNA, 18 bp, Homo Sapiens
  primer_bind 1..18: downstream amplification primer 99-8457 for SEQ 2090, in complement
ctttttttgggatgctgg

SEQ ID NO: 9956 - DNA, 21 bp, Homo Sapiens
  primer_bind 1..21: downstream amplification primer 99-8470 for SEQ 2091, in complement
ttgttactctcacaatcaacc

SEQ ID NO: 9957 - DNA, 20 bp, Homo Sapiens
  primer_bind 1..20: downstream amplification primer 99-8472 for SEQ 2092, in complement
ctttctccatcatagaatag

SEQ ID NO: 9958 - DNA, 19 bp, Homo Sapiens
  primer_bind 1..19: downstream amplification primer 99-8476 for SEQ 2093, in complement
agcaagaccacttggcttc

SEQ ID NO: 9959 - DNA, 18 bp, Homo Sapiens
  primer_bind 1..18: downstream amplification primer 99-8478 for SEQ 2094, in complement
atcccctctttcatttcc

SEQ ID NO: 9960 - DNA, 18 bp, Homo Sapiens
  primer_bind 1..18: downstream amplification primer 99-8487 for SEQ 2095, in complement
gtgccatctactgtactg

SEQ ID NO: 9961 - DNA, 21 bp, Homo Sapiens
  primer_bind 1..21: downstream amplification primer 99-8491 for SEQ 2096, in complement
tactactaattgcagcaaatc

SEQ ID NO: 9962 - DNA, 18 bp, Homo Sapiens
  primer_bind 1..18: downstream amplification primer 99-8499 for SEQ 2097, in complement
cgatctggtgtttccttc

SEQ ID NO: 9963 - DNA, 21 bp, Homo Sapiens
  primer_bind 1..21: downstream amplification primer 99-8505 for SEQ 2098, in complement
ggctgcatactatatgaactg

SEQ ID NO: 9964 - DNA, 21 bp, Homo Sapiens
  primer_bind 1..21: downstream amplification primer 99-851 for SEQ 2099, in complement
gctgtaatgagttgagatttg

SEQ ID NO: 9965 - DNA, 20 bp, Homo Sapiens
  primer_bind 1..20: downstream amplification primer 99-8510 for SEQ 2100, in complement
atcttgtgtccagccctctc

SEQ ID NO: 9966 - DNA, 21 bp, Homo Sapiens
  primer_bind 1..21: downstream amplification primer 99-8514 for SEQ 2101, in complement
gatctgaagcctccagtgatg

SEQ ID NO: 9967 - DNA, 20 bp, Homo Sapiens
  primer_bind 1..20: downstream amplification primer 99-8530 for SEQ 2102, in complement
tggcaaagtggattggacgg

SEQ ID NO: 9968 - DNA, 19 bp, Homo Sapiens
  primer_bind 1..19: downstream amplification primer 99-854 for SEQ 2103, in complement
cagctctataaactctagg

SEQ ID NO: 9969 - DNA, 18 bp, Homo Sapiens
  primer_bind 1..18: downstream amplification primer 99-8546 for SEQ 2104, in complement
ttgcttattacccaggac

SEQ ID NO: 9970 - DNA, 21 bp, Homo Sapiens
  primer_bind 1..21: downstream amplification primer 99-8571 for SEQ 2105, in complement
ataaaacatcagaggcataac

SEQ ID NO: 9971 - DNA, 21 bp, Homo Sapiens
  primer_bind 1..21: downstream amplification primer 99-8575 for SEQ 2106, in complement
ttattcagcatatctcaaagg

SEQ ID NO: 9972 - DNA, 19 bp, Homo Sapiens
  primer_bind 1..19: downstream amplification primer 99-8576 for SEQ 2107, in complement
tcataaggaaaatgtgcag

SEQ ID NO: 9973 - DNA, 20 bp, Homo Sapiens
  primer_bind 1..20: downstream amplification primer 99-8578 for SEQ 2108, in complement
agtgtattcagccagacgcc

SEQ ID NO: 9974 - DNA, 21 bp, Homo Sapiens
  primer_bind 1..21: downstream amplification primer 99-8581 for SEQ 2109, in complement
tatctgatgctggagagtgtg

SEQ ID NO: 9975 - DNA, 21 bp, Homo Sapiens
  primer_bind 1..21: downstream amplification primer 99-8583 for SEQ 2110, in complement
catggatgactacttaactgg

SEQ ID NO: 9976 - DNA, 18 bp, Homo Sapiens
  primer_bind 1..18: downstream amplification primer 99-8588 for SEQ 2111, in complement
gagctagtatgattgggg

SEQ ID NO: 9977 - DNA, 21 bp, Homo Sapiens
  primer_bind 1..21: downstream amplification primer 99-8590 for SEQ 2112, in complement
acagatgattggtcaagagag

SEQ ID NO: 9978 - DNA, 21 bp, Homo Sapiens
  primer_bind 1..21: downstream amplification primer 99-860 for SEQ 2113, in complement
gccttggcattttaataatac

SEQ ID NO: 9979 - DNA, 18 bp, Homo Sapiens
  primer_bind 1..18: downstream amplification primer 99-8600 for SEQ 2114, in complement
agcaaaatctgcacatgg

SEQ ID NO: 9980 - DNA, 21 bp, Homo Sapiens
  primer_bind 1..21: downstream amplification primer 99-8609 for SEQ 2115, in complement
atagctctattagaagccgtg

SEQ ID NO: 9981 - DNA, 21 bp, Homo Sapiens
  primer_bind 1..21: downstream amplification primer 99-8611 for SEQ 2116, in complement
gtggtgtctcttgctttttgg

SEQ ID NO: 9982 - DNA, 21 bp, Homo Sapiens
  primer_bind 1..21: downstream amplification primer 99-862 for SEQ 2117, in complement
aaaagataccagataccatag

SEQ ID NO: 9983 - DNA, 20 bp, Homo Sapiens
  primer_bind 1..20: downstream amplification primer 99-8626 for SEQ 2118, in complement
atggggacaatggcttggac

SEQ ID NO: 9984 - DNA, 18 bp, Homo Sapiens
  primer_bind 1..18: downstream amplification primer 99-8632 for SEQ 2119, in complement
gcaggaaacgccagcttg

SEQ ID NO: 9985 - DNA, 20 bp, Homo Sapiens
  primer_bind 1..20: downstream amplification primer 99-8638 for SEQ 2120, in complement
gccataaatagcaacataac

SEQ ID NO: 9986 - DNA, 21 bp, Homo Sapiens
  primer_bind 1..21: downstream amplification primer 99-8641 for SEQ 2121, in complement
ttacccatctattcattccac

SEQ ID NO: 9987 - DNA, 21 bp, Homo Sapiens
  primer_bind 1..21: downstream amplification primer 99-8648 for SEQ 2122, in complement
atccaccatcagaatgaatag

SEQ ID NO: 9988 - DNA, 21 bp, Homo Sapiens
  primer_bind 1..21: downstream amplification primer 99-8654 for SEQ 2123, in complement
tatagacaagcagataacaac

SEQ ID NO: 9989 - DNA, 20 bp, Homo Sapiens
  primer_bind 1..20: downstream amplification primer 99-8655 for SEQ 2124, in complement
atttatattttcccttcccc

SEQ ID NO: 9990 - DNA, 19 bp, Homo Sapiens
  primer_bind 1..19: downstream amplification primer 99-8658 for SEQ 2125, in complement
ttctgtgttctcagtaatc

SEQ ID NO: 9991 - DNA, 21 bp, Homo Sapiens
  primer_bind 1..21: downstream amplification primer 99-866 for SEQ 2126, in complement
tagggagagtagattagattg

SEQ ID NO: 9992 - DNA, 21 bp, Homo Sapiens
  primer_bind 1..21: downstream amplification primer 99-8662 for SEQ 2127, in complement
ttcctaaagaagcaaatctcc

SEQ ID NO: 9993 - DNA, 21 bp, Homo Sapiens
  primer_bind 1..21: downstream amplification primer 99-8663 for SEQ 2128, in complement
gaatgtctgtgtttaaagttg

SEQ ID NO: 9994 - DNA, 18 bp, Homo Sapiens
  primer_bind 1..18: downstream amplification primer 99-8665 for SEQ 2129, in complement
ggaataccagcaaaccag

SEQ ID NO: 9995 - DNA, 18 bp, Homo Sapiens
  primer_bind 1..18: downstream amplification primer 99-8671 for SEQ 2130, in complement
aagatacacagttgggag

SEQ ID NO: 9996 - DNA, 19 bp, Homo Sapiens
  primer_bind 1..19: downstream amplification primer 99-8695 for SEQ 2131, in complement
tcagggtctactctctctc

SEQ ID NO: 9997 - DNA, 19 bp, Homo Sapiens
  primer_bind 1..19: downstream amplification primer 99-870 for SEQ 2132, in complement
aatatttttgggggagggg

SEQ ID NO: 9998 - DNA, 21 bp, Homo Sapiens
  primer_bind 1..21: downstream amplification primer 99-8703 for SEQ 2133, in complement
aaaacagcatcccctctaacc

SEQ ID NO: 9999 - DNA, 21 bp, Homo Sapiens
  primer_bind 1..21: downstream amplification primer 99-8715 for SEQ 2134, in complement
cagaatttagttcagagaagg

SEQ ID NO: 10000 - DNA, 21 bp, Homo Sapiens
  primer_bind 1..21: downstream amplification primer 99-8725 for SEQ 2135, in complement
cctttcaaatagtaccaggac

SEQ ID NO: 10001 - DNA, 19 bp, Homo Sapiens
  primer_bind 1..19: downstream amplification primer 99-8732 for SEQ 2136, in complement
agacacaacaagaagtaag

SEQ ID NO: 10002 - DNA, 18 bp, Homo Sapiens
  primer_bind 1..18: downstream amplification primer 99-8744 for SEQ 2137, in complement
aaggggtgggtaaacaag

SEQ ID NO: 10003 - DNA, 21 bp, Homo Sapiens
  primer_bind 1..21: downstream amplification primer 99-8748 for SEQ 2138, in complement
ggagtattatacgagaaatag

SEQ ID NO: 10004 - DNA, 18 bp, Homo Sapiens
  primer_bind 1..18: downstream amplification primer 99-8755 for SEQ 2139, in complement
ccctggctaatatgtctc

SEQ ID NO: 10005 - DNA, 21 bp, Homo Sapiens
  primer_bind 1..21: downstream amplification primer 99-8761 for SEQ 2140, in complement
atgtcagggaacagactttgg

SEQ ID NO: 10006 - DNA, 21 bp, Homo Sapiens
  primer_bind 1..21: downstream amplification primer 99-8775 for SEQ 2141, in complement
aacctcattcccattctcatc

SEQ ID NO: 10007 - DNA, 18 bp, Homo Sapiens
  primer_bind 1..18: downstream amplification primer 99-8778 for SEQ 2142, in complement
tgtctttccgcccttttc

SEQ ID NO: 10008 - DNA, 21 bp, Homo Sapiens
  primer_bind 1..21: downstream amplification primer 99-8780 for SEQ 2143, in complement
cagtgtgtttgagcagagtag

SEQ ID NO: 10009 - DNA, 18 bp, Homo Sapiens
  primer_bind 1..18: downstream amplification primer 99-8796 for SEQ 2144, in complement
cttgctctggtttccttc

SEQ ID NO: 10010 - DNA, 21 bp, Homo Sapiens
  primer_bind 1..21: downstream amplification primer 99-8799 for SEQ 2145, in complement
ctgctggagagaagagatatg

SEQ ID NO: 10011 - DNA, 21 bp, Homo Sapiens
  primer_bind 1..21: downstream amplification primer 99-88 for SEQ 2146, in complement
catagcagcattaaagacaag

SEQ ID NO: 10012 - DNA, 21 bp, Homo Sapiens
  primer_bind 1..21: downstream amplification primer 99-8800 for SEQ 2147, in complement
ttctttttcttttcttggagg

SEQ ID NO: 10013 - DNA, 19 bp, Homo Sapiens
  primer_bind 1..19: downstream amplification primer 99-8802 for SEQ 2148, in complement
acgtattatatgctaggtg

SEQ ID NO: 10014 - DNA, 18 bp, Homo Sapiens
  primer_bind 1..18: downstream amplification primer 99-8804 for SEQ 2149, in complement
taggatttgggatacagg

SEQ ID NO: 10015 - DNA, 18 bp, Homo Sapiens
  primer_bind 1..18: downstream amplification primer 99-8812 for SEQ 2150, in complement
cttctttctgccactgtc

SEQ ID NO: 10016 - DNA, 18 bp, Homo Sapiens
  primer_bind 1..18: downstream amplification primer 99-8827 for SEQ 2151, in complement
ttcttctctcctccatac

SEQ ID NO: 10017 - DNA, 18 bp, Homo Sapiens
  primer_bind 1..18: downstream amplification primer 99-8831 for SEQ 2152, in complement
tttttgagggtggggaag

SEQ ID NO: 10018 - DNA, 19 bp, Homo Sapiens
  primer_bind 1..19: downstream amplification primer 99-8835 for SEQ 2153, in complement
ttgaaatggagtaggaaag

SEQ ID NO: 10019 - DNA, 21 bp, Homo Sapiens
  primer_bind 1..21: downstream amplification primer 99-8849 for SEQ 2154, in complement
tgctcagtaattcctcagtag

SEQ ID NO: 10020 - DNA, 21 bp, Homo Sapiens
  primer_bind 1..21: downstream amplification primer 99-8857 for SEQ 2155, in complement
tttcactcaacaaaattacgg

SEQ ID NO: 10021 - DNA, 19 bp, Homo Sapiens
  primer_bind 1..19: downstream amplification primer 99-8866 for SEQ 2156, in complement
ctggagtctgcatattaac

SEQ ID NO: 10022 - DNA, 20 bp, Homo Sapiens
  primer_bind 1..20: downstream amplification primer 99-8867 for SEQ 2157, in complement
atatacttagaagagtgctg

SEQ ID NO: 10023 - DNA, 20 bp, Homo Sapiens
  primer_bind 1..20: downstream amplification primer 99-8872 for SEQ 2158, in complement
aaagcaagtggtggagggtg

SEQ ID NO: 10024 - DNA, 18 bp, Homo Sapiens
  primer_bind 1..18: downstream amplification primer 99-8885 for SEQ 2159, in complement
tctctctacttggtcttc

SEQ ID NO: 10025 - DNA, 21 bp, Homo Sapiens
  primer_bind 1..21: downstream amplification primer 99-8887 for SEQ 2160, in complement
gaaaataactgctgaatatcc

SEQ ID NO: 10026 - DNA, 19 bp, Homo Sapiens
  primer_bind 1..19: downstream amplification primer 99-8894 for SEQ 2161, in complement
cacaaggcattgacaccag

SEQ ID NO: 10027 - DNA, 18 bp, Homo Sapiens
  primer_bind 1..18: downstream amplification primer 99-8895 for SEQ 2162, in complement
cgcaagccatttcttgac

SEQ ID NO: 10028 - DNA, 19 bp, Homo Sapiens
  primer_bind 1..19: downstream amplification primer 99-8901 for SEQ 2163, in complement
cagtcttcactatttcttg

SEQ ID NO: 10029 - DNA, 21 bp, Homo Sapiens
  primer_bind 1..21: downstream amplification primer 99-8905 for SEQ 2164, in complement
ctctaggaatttactcttagg

SEQ ID NO: 10030 - DNA, 20 bp, Homo Sapiens
  primer_bind 1..20: downstream amplification primer 99-8910 for SEQ 2165, in complement
taaagaaacttcctcgcttg

SEQ ID NO: 10031 - DNA, 19 bp, Homo Sapiens
  primer_bind 1..19: downstream amplification primer 99-8923 for SEQ 2166, in complement
gtatttagacaatagccag

SEQ ID NO: 10032 - DNA, 21 bp, Homo Sapiens
  primer_bind 1..21: downstream amplification primer 99-8924 for SEQ 2167, in complement
aatttctccagcttttctacc

SEQ ID NO: 10033 - DNA, 19 bp, Homo Sapiens
  primer_bind 1..19: downstream amplification primer 99-8960 for SEQ 2168, in complement
tcttttccccttagcttcc

SEQ ID NO: 10034 - DNA, 21 bp, Homo Sapiens
  primer_bind 1..21: downstream amplification primer 99-8963 for SEQ 2169, in complement
tttgtcaagaaaacctatgcc

SEQ ID NO: 10035 - DNA, 21 bp, Homo Sapiens
  primer_bind 1..21: downstream amplification primer 99-8974 for SEQ 2170, in complement
ctggaatcaagcaaactttac

SEQ ID NO: 10036 - DNA, 21 bp, Homo Sapiens
  primer_bind 1..21: downstream amplification primer 99-8978 for SEQ 2171, in complement
tcccatccccataataatgag

SEQ ID NO: 10037 - DNA, 18 bp, Homo Sapiens
  primer_bind 1..18: downstream amplification primer 99-8992 for SEQ 2172, in complement
ggtggtgaatgtgtgatg

SEQ ID NO: 10038 - DNA, 21 bp, Homo Sapiens
  primer_bind 1..21: downstream amplification primer 99-9015 for SEQ 2173, in complement
aactcttgtatcagatgtgcc

SEQ ID NO: 10039 - DNA, 21 bp, Homo Sapiens
  primer_bind 1..21: downstream amplification primer 99-9020 for SEQ 2174, in complement
aaggaggttgtttttaggagg

SEQ ID NO: 10040 - DNA, 21 bp, Homo Sapiens
  primer_bind 1..21: downstream amplification primer 99-9026 for SEQ 2175, in complement
ctctaacatttcacacaaaac

SEQ ID NO: 10041 - DNA, 21 bp, Homo Sapiens
  primer_bind 1..21: downstream amplification primer 99-9029 for SEQ 2176, in complement
attttgaggcttttggacttg

SEQ ID NO: 10042 - DNA, 19 bp, Homo Sapiens
  primer_bind 1..19: downstream amplification primer 99-9047 for SEQ 2177, in complement
ctatctactctttagcatc

SEQ ID NO: 10043 - DNA, 21 bp, Homo Sapiens
  primer_bind 1..21: downstream amplification primer 99-9053 for SEQ 2178, in complement
tgacaatctcacttcatttgg

SEQ ID NO: 10044 - DNA, 18 bp, Homo Sapiens
  primer_bind 1..18: downstream amplification primer 99-9059 for SEQ 2179, in complement
tccccttttcctttttcc

SEQ ID NO: 10045 - DNA, 18 bp, Homo Sapiens
  primer_bind 1..18: downstream amplification primer 99-9061 for SEQ 2180, in complement
cataaactgaacccaccc

SEQ ID NO: 10046 - DNA, 18 bp, Homo Sapiens
  primer_bind 1..18: downstream amplification primer 99-9064 for SEQ 2181, in complement
tctccaataacctggctc

SEQ ID NO: 10047 - DNA, 19 bp, Homo Sapiens
  primer_bind 1..19: downstream amplification primer 99-9079 for SEQ 2182, in complement
ttcacaattagaacaggag

SEQ ID NO: 10048 - DNA, 21 bp, Homo Sapiens
  primer_bind 1..21: downstream amplification primer 99-9084 for SEQ 2183, in complement
gaaagaggcatcctccatctg

SEQ ID NO: 10049 - DNA, 19 bp, Homo Sapiens
  primer_bind 1..19: downstream amplification primer 99-9092 for SEQ 2184, in complement
taagatgatcttcagttgg

SEQ ID NO: 10050 - DNA, 21 bp, Homo Sapiens
  primer_bind 1..21: downstream amplification primer 99-9097 for SEQ 2185, in complement
gttttgaagatgaaataggtg

SEQ ID NO: 10051 - DNA, 21 bp, Homo Sapiens
  primer_bind 1..21: downstream amplification primer 99-9105 for SEQ 2186, in complement
attattcacaccttttctccc

SEQ ID NO: 10052 - DNA, 18 bp, Homo Sapiens
  primer_bind 1..18: downstream amplification primer 99-9118 for SEQ 2187, in complement
ggtaagcaacttaggaac

SEQ ID NO: 10053 - DNA, 21 bp, Homo Sapiens
  primer_bind 1..21: downstream amplification primer 99-9120 for SEQ 2188, in complement
caagccatttccttagcaccc

SEQ ID NO: 10054 - DNA, 20 bp, Homo Sapiens
  primer_bind 1..20: downstream amplification primer 99-9126 for SEQ 2189, in complement
gcatgtgtgtgggttgtgag

SEQ ID NO: 10055 - DNA, 20 bp, Homo Sapiens
  primer_bind 1..20: downstream amplification primer 99-913 for SEQ 2190, in complement
tctctgtccatcctctctcc

SEQ ID NO: 10056 - DNA, 20 bp, Homo Sapiens
  primer_bind 1..20: downstream amplification primer 99-9141 for SEQ 2191, in complement
ctaaaatgactaaggattgg

SEQ ID NO: 10057 - DNA, 18 bp, Homo Sapiens
  primer_bind 1..18: downstream amplification primer 99-9152 for SEQ 2192, in complement
cggcgtaactacaaattc

SEQ ID NO: 10058 - DNA, 18 bp, Homo Sapiens
  primer_bind 1..18: downstream amplification primer 99-9157 for SEQ 2193, in complement
tagaagctgtaccctttg

SEQ ID NO: 10059 - DNA, 21 bp, Homo Sapiens
  primer_bind 1..21: downstream amplification primer 99-9175 for SEQ 2194, in complement
cgtgtcttgttgaaatgaatg

SEQ ID NO: 10060 - DNA, 21 bp, Homo Sapiens
  primer_bind 1..21: downstream amplification primer 99-9204 for SEQ 2195, in complement
agtagaagaggagatttagag

SEQ ID NO: 10061 - DNA, 21 bp, Homo Sapiens
  primer_bind 1..21: downstream amplification primer 99-921 for SEQ 2196, in complement
ggaaaataagaaaggaagtgg

SEQ ID NO: 10062 - DNA, 19 bp, Homo Sapiens
  primer_bind 1..19: downstream amplification primer 99-924 for SEQ 2197, in complement
gaaatggtgataattggag

SEQ ID NO: 10063 - DNA, 20 bp, Homo Sapiens
  primer_bind 1..20: downstream amplification primer 99-9240 for SEQ 2198, in complement
gtcatgggttagtaaccttg

SEQ ID NO: 10064 - DNA, 18 bp, Homo Sapiens
  primer_bind 1..18: downstream amplification primer 99-9250 for SEQ 2199, in complement
ataactgcttcatccccc

SEQ ID NO: 10065 - DNA, 18 bp, Homo Sapiens
  primer_bind 1..18: downstream amplification primer 99-9254 for SEQ 2200, in complement
agccaaaggggtgtttag

SEQ ID NO: 10066 - DNA, 18 bp, Homo Sapiens
  primer_bind 1..18: downstream amplification primer 99-926 for SEQ 2201, in complement
gagagagaaaaacttggg

SEQ ID NO: 10067 - DNA, 21 bp, Homo Sapiens
  primer_bind 1..21: downstream amplification primer 99-9263 for SEQ 2202, in complement
gagaaatgttaggaactgtgg

SEQ ID NO: 10068 - DNA, 19 bp, Homo Sapiens
  primer_bind 1..19: downstream amplification primer 99-9271 for SEQ 2203, in complement
atgttgagtgagaaagaag

SEQ ID NO: 10069 - DNA, 20 bp, Homo Sapiens
  primer_bind 1..20: downstream amplification primer 99-9274 for SEQ 2204, in complement
tccctatcatttctcatcac

SEQ ID NO: 10070 - DNA, 21 bp, Homo Sapiens
  primer_bind 1..21: downstream amplification primer 99-9276 for SEQ 2205, in complement
agaatagtctcgtgaggtgtg

SEQ ID NO: 10071 - DNA, 20 bp, Homo Sapiens
  primer_bind 1..20: downstream amplification primer 99-9355 for SEQ 2206, in complement
ctttctctctttcatctatc

SEQ ID NO: 10072 - DNA, 18 bp, Homo Sapiens
  primer_bind 1..18: downstream amplification primer 99-9368 for SEQ 2207, in complement
aacaccaccactatttcc

SEQ ID NO: 10073 - DNA, 21 bp, Homo Sapiens
  primer_bind 1..21: downstream amplification primer 99-937 for SEQ 2208, in complement
ttcagaaaggatacataaagc

SEQ ID NO: 10074 - DNA, 21 bp, Homo Sapiens
  primer_bind 1..21: downstream amplification primer 99-9372 for SEQ 2209, in complement
tatgctaataccaaaccagac

SEQ ID NO: 10075 - DNA, 19 bp, Homo Sapiens
  primer_bind 1..19: downstream amplification primer 99-9381 for SEQ 2210, in complement
cctttgatttacctctgac

SEQ ID NO: 10076 - DNA, 21 bp, Homo Sapiens
  primer_bind 1..21: downstream amplification primer 99-9385 for SEQ 2211, in complement
ctgtgatatattaagaagagg

SEQ ID NO: 10077 - DNA, 21 bp, Homo Sapiens
  primer_bind 1..21: downstream amplification primer 99-9389 for SEQ 2212, in complement
tcagcaattatgctatctttg

SEQ ID NO: 10078 - DNA, 18 bp, Homo Sapiens
  primer_bind 1..18: downstream amplification primer 99-9395 for SEQ 2213, in complement
aacaaatcccaaccgtcc

SEQ ID NO: 10079 - DNA, 19 bp, Homo Sapiens
  primer_bind 1..19: downstream amplification primer 99-9401 for SEQ 2214, in complement
aacttatgaactctccaac

SEQ ID NO: 10080 - DNA, 19 bp, Homo Sapiens
  primer_bind 1..19: downstream amplification primer 99-9402 for SEQ 2215, in complement
tcctcacaccctcatcaac

SEQ ID NO: 10081 - DNA, 19 bp, Homo Sapiens
  primer_bind 1..19: downstream amplification primer 99-9404 for SEQ 2216, in complement
gcttattccttcacatctg

SEQ ID NO: 10082 - DNA, 21 bp, Homo Sapiens
  primer_bind 1..21: downstream amplification primer 99-9405 for SEQ 2217, in complement
aaaatcccccttggtatgttg

SEQ ID NO: 10083 - DNA, 18 bp, Homo Sapiens
  primer_bind 1..18: downstream amplification primer 99-941 for SEQ 2218, in complement
tctctcctcatccctttc

SEQ ID NO: 10084 - DNA, 21 bp, Homo Sapiens
  primer_bind 1..21: downstream amplification primer 99-9410 for SEQ 2219, in complement
agattgagaaggaagaaaaag

SEQ ID NO: 10085 - DNA, 21 bp, Homo Sapiens
  primer_bind 1..21: downstream amplification primer 99-9412 for SEQ 2220, in complement
cagtaatgaaaaggaatgaac

SEQ ID NO: 10086 - DNA, 21 bp, Homo Sapiens
  primer_bind 1..21: downstream amplification primer 99-9417 for SEQ 2221, in complement
gataaagtgatgtgttatagg

SEQ ID NO: 10087 - DNA, 21 bp, Homo Sapiens
  primer_bind 1..21: downstream amplification primer 99-942 for SEQ 2222, in complement
ctcccagttttccaaagtacc

SEQ ID NO: 10088 - DNA, 21 bp, Homo Sapiens
  primer_bind 1..21: downstream amplification primer 99-9420 for SEQ 2223, in complement
cataagacagaggtaagttag

SEQ ID NO: 10089 - DNA, 19 bp, Homo Sapiens
  primer_bind 1..19: downstream amplification primer 99-9421 for SEQ 2224, in complement
ataattcaacttacccagc

SEQ ID NO: 10090 - DNA, 19 bp, Homo Sapiens
  primer_bind 1..19: downstream amplification primer 99-9422 for SEQ 2225, in complement
actgaatgggggaaaactg

SEQ ID NO: 10091 - DNA, 20 bp, Homo Sapiens
  primer_bind 1..20: downstream amplification primer 99-9423 for SEQ 2226, in complement
gaaatgtcctcccgctcttg

SEQ ID NO: 10092 - DNA, 21 bp, Homo Sapiens
  primer_bind 1..21: downstream amplification primer 99-9424 for SEQ 2227, in complement
atgcttctagctgtttttccc

SEQ ID NO: 10093 - DNA, 21 bp, Homo Sapiens
  primer_bind 1..21: downstream amplification primer 99-9427 for SEQ 2228, in complement
ctcacagaaatagtcaaaatc

SEQ ID NO: 10094 - DNA, 21 bp, Homo Sapiens
  primer_bind 1..21: downstream amplification primer 99-9446 for SEQ 2229, in complement
gaagaaacaagaaaccaatcc

SEQ ID NO: 10095 - DNA, 18 bp, Homo Sapiens
  primer_bind 1..18: downstream amplification primer 99-9448 for SEQ 2230, in complement
gagaaggggtcaagaaag

SEQ ID NO: 10096 - DNA, 20 bp, Homo Sapiens
  primer_bind 1..20: downstream amplification primer 99-9462 for SEQ 2231, in complement
caagaagtggctaataaaac

SEQ ID NO: 10097 - DNA, 18 bp, Homo Sapiens
  primer_bind 1..18: downstream amplification primer 99-9471 for SEQ 2232, in complement
agcaagtaacactgtgcc

SEQ ID NO: 10098 - DNA, 21 bp, Homo Sapiens
  primer_bind 1..21: downstream amplification primer 99-949 for SEQ 2233, in complement
ctaaaattgtactcttccccc

SEQ ID NO: 10099 - DNA, 19 bp, Homo Sapiens
  primer_bind 1..19: downstream amplification primer 99-9491 for SEQ 2234, in complement
gttgtctgcatcatatctc

SEQ ID NO: 10100 - DNA, 19 bp, Homo Sapiens
  primer_bind 1..19: downstream amplification primer 99-9493 for SEQ 2235, in complement
gtttggataatctcaccac

SEQ ID NO: 10101 - DNA, 20 bp, Homo Sapiens
  primer_bind 1..20: downstream amplification primer 99-9499 for SEQ 2236, in complement
atgctctctcctcctggaag

SEQ ID NO: 10102 - DNA, 19 bp, Homo Sapiens
  primer_bind 1..19: downstream amplification primer 99-950 for SEQ 2237, in complement
tggagtgttcagaatttag

SEQ ID NO: 10103 - DNA, 18 bp, Homo Sapiens
  primer_bind 1..18: downstream amplification primer 99-9513 for SEQ 2238, in complement
agtatgttgtgggaaggg

SEQ ID NO: 10104 - DNA, 18 bp, Homo Sapiens
  primer_bind 1..18: downstream amplification primer 99-952 for SEQ 2239, in complement
aacagtacacacttgggc

SEQ ID NO: 10105 - DNA, 18 bp, Homo Sapiens
  primer_bind 1..18: downstream amplification primer 99-9527 for SEQ 2240, in complement
tctgctctgcttgtgttc

SEQ ID NO: 10106 - DNA, 21 bp, Homo Sapiens
  primer_bind 1..21: downstream amplification primer 99-9531 for SEQ 2241, in complement
aggagtttgtgaagtgagaag

SEQ ID NO: 10107 - DNA, 18 bp, Homo Sapiens
  primer_bind 1..18: downstream amplification primer 99-9538 for SEQ 2242, in complement
tctatggaggggagaggg

SEQ ID NO: 10108 - DNA, 21 bp, Homo Sapiens
  primer_bind 1..21: downstream amplification primer 99-954 for SEQ 2243, in complement
aacgctgaggctaaaaagaag

SEQ ID NO: 10109 - DNA, 18 bp, Homo Sapiens
  primer_bind 1..18: downstream amplification primer 99-9542 for SEQ 2244, in complement
atctggctaatgctgcac

SEQ ID NO: 10110 - DNA, 21 bp, Homo Sapiens
  primer_bind 1..21: downstream amplification primer 99-9545 for SEQ 2245, in complement
tctaattttccccttctttcc

SEQ ID NO: 10111 - DNA, 19 bp, Homo Sapiens
  primer_bind 1..19: downstream amplification primer 99-9554 for SEQ 2246, in complement
tgcctcttcctcagcaatc

SEQ ID NO: 10112 - DNA, 18 bp, Homo Sapiens
  primer_bind 1..18: downstream amplification primer 99-9555 for SEQ 2247, in complement
aggtaacgagggtatagg

SEQ ID NO: 10113 - DNA, 21 bp, Homo Sapiens
  primer_bind 1..21: downstream amplification primer 99-9556 for SEQ 2248, in complement
cccctatttggtgacagactc

SEQ ID NO: 10114 - DNA, 18 bp, Homo Sapiens
  primer_bind 1..18: downstream amplification primer 99-9567 for SEQ 2249, in complement
gtgcttgctttgttcttg

SEQ ID NO: 10115 - DNA, 19 bp, Homo Sapiens
  primer_bind 1..19: downstream amplification primer 99-9572 for SEQ 2250, in complement
gagaaatataccccgattg

SEQ ID NO: 10116 - DNA, 20 bp, Homo Sapiens
  primer_bind 1..20: downstream amplification primer 99-9577 for SEQ 2251, in complement
gtgtcttagtattttcagtg

SEQ ID NO: 10117 - DNA, 21 bp, Homo Sapiens
  primer_bind 1..21: downstream amplification primer 99-9579 for SEQ 2252, in complement
gagttgatactaaagtttctg

SEQ ID NO: 10118 - DNA, 19 bp, Homo Sapiens
  primer_bind 1..19: downstream amplification primer 99-958 for SEQ 2253, in complement
atattttcccacatccatc

SEQ ID NO: 10119 - DNA, 19 bp, Homo Sapiens
  primer_bind 1..19: downstream amplification primer 99-9587 for SEQ 2254, in complement
aaaagtgatgagaagagac

SEQ ID NO: 10120 - DNA, 20 bp, Homo Sapiens
  primer_bind 1..20: downstream amplification primer 99-961 for SEQ 2255, in complement
gcagaaataaatacatgcac

SEQ ID NO: 10121 - DNA, 21 bp, Homo Sapiens
  primer_bind 1..21: downstream amplification primer 99-963 for SEQ 2256, in complement
cagttctattctcatacatac

SEQ ID NO: 10122 - DNA, 20 bp, Homo Sapiens
  primer_bind 1..20: downstream amplification primer 99-965 for SEQ 2257, in complement
cataagaacctactaaatcc

SEQ ID NO: 10123 - DNA, 18 bp, Homo Sapiens
  primer_bind 1..18: downstream amplification primer 99-967 for SEQ 2258, in complement
cttgcctgaacttctatg

SEQ ID NO: 10124 - DNA, 20 bp, Homo Sapiens
  primer_bind 1..20: downstream amplification primer 99-976 for SEQ 2259, in complement
gactatcaaacaaaataccc

SEQ ID NO: 10125 - DNA, 21 bp, Homo Sapiens
  primer_bind 1..21: downstream amplification primer 99-979 for SEQ 2260, in complement
cttctgtgtgtctatttcttg

SEQ ID NO: 10126 - DNA, 21 bp, Homo Sapiens
  primer_bind 1..21: downstream amplification primer 99-10000 for SEQ 2261, in complement
ttgctgaagtttctgcctctg

SEQ ID NO: 10127 - DNA, 21 bp, Homo Sapiens
  primer_bind 1..21: downstream amplification primer 99-10016 for SEQ 2262, in complement
atatttcaagaggcatattgg

SEQ ID NO: 10128 - DNA, 21 bp, Homo Sapiens
  primer_bind 1..21: downstream amplification primer 99-10027 for SEQ 2263, in complement
gcaggggtaagtagaatcaag

SEQ ID NO: 10129 - DNA, 21 bp, Homo Sapiens
  primer_bind 1..21: downstream amplification primer 99-10028 for SEQ 2264, in complement
ctgctctttgattgtgcttcc

SEQ ID NO: 10130 - DNA, 21 bp, Homo Sapiens
  primer_bind 1..21: downstream amplification primer 99-10031 for SEQ 2265, in complement
ggcagaagaacaagtttcagg

SEQ ID NO: 10131 - DNA, 19 bp, Homo Sapiens
  primer_bind 1..19: downstream amplification primer 99-10046 for SEQ 2266, in complement
tgtagactgattgttttcc

SEQ ID NO: 10132 - DNA, 21 bp, Homo Sapiens
  primer_bind 1..21: downstream amplification primer 99-10064 for SEQ 2267, in complement
ctactgattatgagagaattg

SEQ ID NO: 10133 - DNA, 19 bp, Homo Sapiens
  primer_bind 1..19: downstream amplification primer 99-10066 for SEQ 2268, in complement
aatgtccactgatctattg

SEQ ID NO: 10134 - DNA, 21 bp, Homo Sapiens
  primer_bind 1..21: downstream amplification primer 99-10067 for SEQ 2269, in complement
tgtataatcctgttacctatg

SEQ ID NO: 10135 - DNA, 21 bp, Homo Sapiens
  primer_bind 1..21: downstream amplification primer 99-10078 for SEQ 2270, in complement
atagtgtcaaggggcagtaac

SEQ ID NO: 10136 - DNA, 21 bp, Homo Sapiens
  primer_bind 1..21: downstream amplification primer 99-10104 for SEQ 2271, in complement
atccctacagagagataatcc

SEQ ID NO: 10137 - DNA, 21 bp, Homo Sapiens
  primer_bind 1..21: downstream amplification primer 99-10106 for SEQ 2272, in complement
aatggttgtaaggaatagagg

SEQ ID NO: 10138 - DNA, 20 bp, Homo Sapiens
  primer_bind 1..20: downstream amplification primer 99-10108 for SEQ 2273, in complement
catgaaaactcttcgtttgg

SEQ ID NO: 10139 - DNA, 21 bp, Homo Sapiens
  primer_bind 1..21: downstream amplification primer 99-10118 for SEQ 2274, in complement
tgaaaggatgatgagagtagg

SEQ ID NO: 10140 - DNA, 21 bp, Homo Sapiens
  primer_bind 1..21: downstream amplification primer 99-10126 for SEQ 2275, in complement
ctctcccatagtacaaaagcc

SEQ ID NO: 10141 - DNA, 19 bp, Homo Sapiens
  primer_bind 1..19: downstream amplification primer 99-10127 for SEQ 2276, in complement
catatctactttaggggac

SEQ ID NO: 10142 - DNA, 21 bp, Homo Sapiens
  primer_bind 1..21: downstream amplification primer 99-10137 for SEQ 2277, in complement
tgaaatgtaaggagaagggag

SEQ ID NO: 10143 - DNA, 21 bp, Homo Sapiens
  primer_bind 1..21: downstream amplification primer 99-10142 for SEQ 2278, in complement
ggttgtccacaatttttagag

SEQ ID NO: 10144 - DNA, 21 bp, Homo Sapiens
  primer_bind 1..21: downstream amplification primer 99-10143 for SEQ 2279, in complement
tccaaagtaacaagtcaacag

SEQ ID NO: 10145 - DNA, 21 bp, Homo Sapiens
  primer_bind 1..21: downstream amplification primer 99-10146 for SEQ 2280, in complement
tatctctatgcttgtactctg

SEQ ID NO: 10146 - DNA, 20 bp, Homo Sapiens
  primer_bind 1..20: downstream amplification primer 99-10149 for SEQ 2281, in complement
tagtcactcatatttggctc

SEQ ID NO: 10147 - DNA, 20 bp, Homo Sapiens
  primer_bind 1..20: downstream amplification primer 99-10151 for SEQ 2282, in complement
taaactagctgctggctccg

SEQ ID NO: 10148 - DNA, 20 bp, Homo Sapiens
  primer_bind 1..20: downstream amplification primer 99-10153 for SEQ 2283, in complement
tagatggggggaaacagagg

SEQ ID NO: 10149 - DNA, 20 bp, Homo Sapiens
  primer_bind 1..20: downstream amplification primer 99-10155 for SEQ 2284, in complement
ccttcctcattgttttcctc

SEQ ID NO: 10150 - DNA, 21 bp, Homo Sapiens
  primer_bind 1..21: downstream amplification primer 99-10173 for SEQ 2285, in complement
tgtgccaaaaaaaatgtgtcc

SEQ ID NO: 10151 - DNA, 21 bp, Homo Sapiens
  primer_bind 1..21: downstream amplification primer 99-10179 for SEQ 2286, in complement
ttagtttggttgttcccattc

SEQ ID NO: 10152 - DNA, 18 bp, Homo Sapiens
  primer_bind 1..18: downstream amplification primer 99-1018 for SEQ 2287, in complement
tgagttcaaatcccacag

SEQ ID NO: 10153 - DNA, 20 bp, Homo Sapiens
  primer_bind 1..20: downstream amplification primer 99-10183 for SEQ 2288, in complement
tggattggagaatttagaag

SEQ ID NO: 10154 - DNA, 21 bp, Homo Sapiens
  primer_bind 1..21: downstream amplification primer 99-10185 for SEQ 2289, in complement
attagaaattagcctacaacc

SEQ ID NO: 10155 - DNA, 21 bp, Homo Sapiens
  primer_bind 1..21: downstream amplification primer 99-10188 for SEQ 2290, in complement
gtgggataagagtaaaaggtg

SEQ ID NO: 10156 - DNA, 21 bp, Homo Sapiens
  primer_bind 1..21: downstream amplification primer 99-10201 for SEQ 2291, in complement
tgggaagtagtttaggtaatc

SEQ ID NO: 10157 - DNA, 18 bp, Homo Sapiens
  primer_bind 1..18: downstream amplification primer 99-10207 for SEQ 2292, in complement
gtagccaataaccacacc

SEQ ID NO: 10158 - DNA, 21 bp, Homo Sapiens
  primer_bind 1..21: downstream amplification primer 99-10211 for SEQ 2293, in complement
cttagtggactcaagaacaac

SEQ ID NO: 10159 - DNA, 21 bp, Homo Sapiens
  primer_bind 1..21: downstream amplification primer 99-10216 for SEQ 2294, in complement
tgtctcctataaacagcaacc

SEQ ID NO: 10160 - DNA, 21 bp, Homo Sapiens
  primer_bind 1..21: downstream amplification primer 99-10220 for SEQ 2295, in complement
agcaagaggcagttttgctac

SEQ ID NO: 10161 - DNA, 21 bp, Homo Sapiens
  primer_bind 1..21: downstream amplification primer 99-10223 for SEQ 2296, in complement
tccttctctgttactcctttc

SEQ ID NO: 10162 - DNA, 21 bp, Homo Sapiens
  primer_bind 1..21: downstream amplification primer 99-10224 for SEQ 2297, in complement
gggaaactgggaattatattg

SEQ ID NO: 10163 - DNA, 21 bp, Homo Sapiens
  primer_bind 1..21: downstream amplification primer 99-10234 for SEQ 2298, in complement
accaaatctaactctgcttac

SEQ ID NO: 10164 - DNA, 18 bp, Homo Sapiens
  primer_bind 1..18: downstream amplification primer 99-1024 for SEQ 2299, in complement
tactccttagccatcacc

SEQ ID NO: 10165 - DNA, 21 bp, Homo Sapiens
  primer_bind 1..21: downstream amplification primer 99-10245 for SEQ 2300, in complement
gaaaaataagagttgtaggag

SEQ ID NO: 10166 - DNA, 20 bp, Homo Sapiens
  primer_bind 1..20: downstream amplification primer 99-10256 for SEQ 2301, in complement
tgtggggatagtggacacag

SEQ ID NO: 10167 - DNA, 21 bp, Homo Sapiens
  primer_bind 1..21: downstream amplification primer 99-10264 for SEQ 2302, in complement
aatgggaagttagggaatatg

SEQ ID NO: 10168 - DNA, 21 bp, Homo Sapiens
  primer_bind 1..21: downstream amplification primer 99-10266 for SEQ 2303, in complement
accctctctgcttgagtatcc

SEQ ID NO: 10169 - DNA, 21 bp, Homo Sapiens
  primer_bind 1..21: downstream amplification primer 99-10267 for SEQ 2304, in complement
cagggactttcattcatcttc

SEQ ID NO: 10170 - DNA, 21 bp, Homo Sapiens
  primer_bind 1..21: downstream amplification primer 99-10303 for SEQ 2305, in complement
ctgtttaggggtgtcgatagg

SEQ ID NO: 10171 - DNA, 21 bp, Homo Sapiens
  primer_bind 1..21: downstream amplification primer 99-10304 for SEQ 2306, in complement
aaaaaacctgctccaccattg

SEQ ID NO: 10172 - DNA, 20 bp, Homo Sapiens
  primer_bind 1..20: downstream amplification primer 99-10312 for SEQ 2307, in complement
caaacacgcttaacattagg

SEQ ID NO: 10173 - DNA, 21 bp, Homo Sapiens
  primer_bind 1..21: downstream amplification primer 99-10318 for SEQ 2308, in complement
ctttctggagtgaattgtgtc

SEQ ID NO: 10174 - DNA, 20 bp, Homo Sapiens
  primer_bind 1..20: downstream amplification primer 99-10330 for SEQ 2309, in complement
gggtaagtggttttcagaag

SEQ ID NO: 10175 - DNA, 18 bp, Homo Sapiens
  primer_bind 1..18: downstream amplification primer 99-10332 for SEQ 2310, in complement
attttgcgtctccgttag

SEQ ID NO: 10176 - DNA, 18 bp, Homo Sapiens
  primer_bind 1..18: downstream amplification primer 99-10345 for SEQ 2311, in complement
tccttacgctcaggatag

SEQ ID NO: 10177 - DNA, 21 bp, Homo Sapiens
  primer_bind 1..21: downstream amplification primer 99-10353 for SEQ 2312, in complement
catgttgatgttggacatgcc

SEQ ID NO: 10178 - DNA, 21 bp, Homo Sapiens
  primer_bind 1..21: downstream amplification primer 99-10364 for SEQ 2313, in complement
aaaggaagataggagaaaaag

SEQ ID NO: 10179 - DNA, 21 bp, Homo Sapiens
  primer_bind 1..21: downstream amplification primer 99-10369 for SEQ 2314, in complement
gttccatttcagttcacacag

SEQ ID NO: 10180 - DNA, 21 bp, Homo Sapiens
  primer_bind 1..21: downstream amplification primer 99-10374 for SEQ 2315, in complement
taattgcgatggttggacagg

SEQ ID NO: 10181 - DNA, 21 bp, Homo Sapiens
  primer_bind 1..21: downstream amplification primer 99-10381 for SEQ 2316, in complement
atgatgcctgtatgttttatg

SEQ ID NO: 10182 - DNA, 21 bp, Homo Sapiens
  primer_bind 1..21: downstream amplification primer 99-10389 for SEQ 2317, in complement
gaatttcctttgactctgccc

SEQ ID NO: 10183 - DNA, 21 bp, Homo Sapiens
  primer_bind 1..21: downstream amplification primer 99-10390 for SEQ 2318, in complement
aatgtggcagtgaatgcacag

SEQ ID NO: 10184 - DNA, 21 bp, Homo Sapiens
  primer_bind 1..21: downstream amplification primer 99-10414 for SEQ 2319, in complement
gcttattataactcagaaggg

SEQ ID NO: 10185 - DNA, 21 bp, Homo Sapiens
  primer_bind 1..21: downstream amplification primer 99-10434 for SEQ 2320, in complement
cttggtcttggtctatggttg

SEQ ID NO: 10186 - DNA, 19 bp, Homo Sapiens
  primer_bind 1..19: downstream amplification primer 99-10436 for SEQ 2321, in complement
cattactcttcacttcctc

SEQ ID NO: 10187 - DNA, 20 bp, Homo Sapiens
  primer_bind 1..20: downstream amplification primer 99-10438 for SEQ 2322, in complement
agggtgtgtttggcttcagg

SEQ ID NO: 10188 - DNA, 21 bp, Homo Sapiens
  primer_bind 1..21: downstream amplification primer 99-10446 for SEQ 2323, in complement
acacatcacccctttcccaac

SEQ ID NO: 10189 - DNA, 19 bp, Homo Sapiens
  primer_bind 1..19: downstream amplification primer 99-10451 for SEQ 2324, in complement
agacggggacccataatag

SEQ ID NO: 10190 - DNA, 21 bp, Homo Sapiens
  primer_bind 1..21: downstream amplification primer 99-10452 for SEQ 2325, in complement
aacaccaactaactaacaggc

SEQ ID NO: 10191 - DNA, 21 bp, Homo Sapiens
  primer_bind 1..21: downstream amplification primer 99-10457 for SEQ 2326, in complement
tggctgtgagttaaaaaactg

SEQ ID NO: 10192 - DNA, 21 bp, Homo Sapiens
  primer_bind 1..21: downstream amplification primer 99-10470 for SEQ 2327, in complement
ctttcaagcatttaccctctc

SEQ ID NO: 10193 - DNA, 21 bp, Homo Sapiens
  primer_bind 1..21: downstream amplification primer 99-10471 for SEQ 2328, in complement
gacacaggaagaggatatagc

SEQ ID NO: 10194 - DNA, 21 bp, Homo Sapiens
  primer_bind 1..21: downstream amplification primer 99-10473 for SEQ 2329, in complement
ctactcaattagtatctatcc

SEQ ID NO: 10195 - DNA, 20 bp, Homo Sapiens
  primer_bind 1..20: downstream amplification primer 99-10474 for SEQ 2330, in complement
cctcaatcacttagcacaac

SEQ ID NO: 10196 - DNA, 21 bp, Homo Sapiens
  primer_bind 1..21: downstream amplification primer 99-10481 for SEQ 2331, in complement
ttctttcaatcatggaagcac

SEQ ID NO: 10197 - DNA, 20 bp, Homo Sapiens
  primer_bind 1..20: downstream amplification primer 99-10487 for SEQ 2332, in complement
ctaagaggtaattttaggac

SEQ ID NO: 10198 - DNA, 21 bp, Homo Sapiens
  primer_bind 1..21: downstream amplification primer 99-10488 for SEQ 2333, in complement
tctaaccatgttattcccctc

SEQ ID NO: 10199 - DNA, 21 bp, Homo Sapiens
  primer_bind 1..21: downstream amplification primer 99-10491 for SEQ 2334, in complement
agagatggtggagaggagatg

SEQ ID NO: 10200 - DNA, 21 bp, Homo Sapiens
  primer_bind 1..21: downstream amplification primer 99-10499 for SEQ 2335, in complement
gctgggaggattcacaaatgg

SEQ ID NO: 10201 - DNA, 21 bp, Homo Sapiens
  primer_bind 1..21: downstream amplification primer 99-10502 for SEQ 2336, in complement
gggtgagtctatgatttcagg

SEQ ID NO: 10202 - DNA, 21 bp, Homo Sapiens
  primer_bind 1..21: downstream amplification primer 99-10506 for SEQ 2337, in complement
caagctgctaccttcacagag

SEQ ID NO: 10203 - DNA, 20 bp, Homo Sapiens
  primer_bind 1..20: downstream amplification primer 99-10507 for SEQ 2338, in complement
tagggaggcaatgacacagg

SEQ ID NO: 10204 - DNA, 19 bp, Homo Sapiens
  primer_bind 1..19: downstream amplification primer 99-10509 for SEQ 2339, in complement
agtatgtgtttaagaggag

SEQ ID NO: 10205 - DNA, 19 bp, Homo Sapiens
  primer_bind 1..19: downstream amplification primer 99-1051 for SEQ 2340, in complement
cctgggttctgaccttttg

SEQ ID NO: 10206 - DNA, 21 bp, Homo Sapiens
  primer_bind 1..21: downstream amplification primer 99-10513 for SEQ 2341, in complement
tggggaatatttaatagccag

SEQ ID NO: 10207 - DNA, 21 bp, Homo Sapiens
  primer_bind 1..21: downstream amplification primer 99-10514 for SEQ 2342, in complement
tagctgtggtagaatagttgg

SEQ ID NO: 10208 - DNA, 21 bp, Homo Sapiens
  primer_bind 1..21: downstream amplification primer 99-10521 for SEQ 2343, in complement
cactcaaatcctacttcttcc

SEQ ID NO: 10209 - DNA, 20 bp, Homo Sapiens
  primer_bind 1..20: downstream amplification primer 99-10522 for SEQ 2344, in complement
cgtgagaaggtaatgaaatg

SEQ ID NO: 10210 - DNA, 21 bp, Homo Sapiens
  primer_bind 1..21: downstream amplification primer 99-10536 for SEQ 2345, in complement
cccagcacatacccaaattcc

SEQ ID NO: 10211 - DNA, 21 bp, Homo Sapiens
  primer_bind 1..21: downstream amplification primer 99-10539 for SEQ 2346, in complement
atcagagagagactttagagg

SEQ ID NO: 10212 - DNA, 21 bp, Homo Sapiens
  primer_bind 1..21: downstream amplification primer 99-10542 for SEQ 2347, in complement
ttccagagtaaacagaaacag

SEQ ID NO: 10213 - DNA, 19 bp, Homo Sapiens
  primer_bind 1..19: downstream amplification primer 99-10543 for SEQ 2348, in complement
gagactgatatagatttcc

SEQ ID NO: 10214 - DNA, 21 bp, Homo Sapiens
  primer_bind 1..21: downstream amplification primer 99-1055 for SEQ 2349, in complement
atgcagattctcatgcagcag

SEQ ID NO: 10215 - DNA, 21 bp, Homo Sapiens
  primer_bind 1..21: downstream amplification primer 99-10557 for SEQ 2350, in complement
ggaggagacttaaacataggg

SEQ ID NO: 10216 - DNA, 21 bp, Homo Sapiens
  primer_bind 1..21: downstream amplification primer 99-10567 for SEQ 2351, in complement
ggcattaaggagttgaagagg

SEQ ID NO: 10217 - DNA, 21 bp, Homo Sapiens
  primer_bind 1..21: downstream amplification primer 99-10570 for SEQ 2352, in complement
gcattatgaaattccctccac

SEQ ID NO: 10218 - DNA, 19 bp, Homo Sapiens
  primer_bind 1..19: downstream amplification primer 99-10573 for SEQ 2353, in complement
ctgatttcaagctgctaac

SEQ ID NO: 10219 - DNA, 21 bp, Homo Sapiens
  primer_bind 1..21: downstream amplification primer 99-10575 for SEQ 2354, in complement
acaggctctatgagagtgagg

SEQ ID NO: 10220 - DNA, 21 bp, Homo Sapiens
  primer_bind 1..21: downstream amplification primer 99-10576 for SEQ 2355, in complement
aaagacaagatgtgccgccag

SEQ ID NO: 10221 - DNA, 21 bp, Homo Sapiens
  primer_bind 1..21: downstream amplification primer 99-10577 for SEQ 2356, in complement
ttccctccatagtgtatctcc

SEQ ID NO: 10222 - DNA, 21 bp, Homo Sapiens
  primer_bind 1..21: downstream amplification primer 99-10581 for SEQ 2357, in complement
gagtagacaaagagcctcctg

SEQ ID NO: 10223 - DNA, 21 bp, Homo Sapiens
  primer_bind 1..21: downstream amplification primer 99-10589 for SEQ 2358, in complement
caaataattctaagggcagac

SEQ ID NO: 10224 - DNA, 19 bp, Homo Sapiens
  primer_bind 1..19: downstream amplification primer 99-10601 for SEQ 2359, in complement
acagtggatttggacatag

SEQ ID NO: 10225 - DNA, 21 bp, Homo Sapiens
  primer_bind 1..21: downstream amplification primer 99-10606 for SEQ 2360, in complement
tctgtgttgtctctcctcttc

SEQ ID NO: 10226 - DNA, 21 bp, Homo Sapiens
  primer_bind 1..21: downstream amplification primer 99-10608 for SEQ 2361, in complement
cagaaaggaagaagtttttgg

SEQ ID NO: 10227 - DNA, 20 bp, Homo Sapiens
  primer_bind 1..20: downstream amplification primer 99-10613 for SEQ 2362, in complement
acataaagcaatgcacaagg

SEQ ID NO: 10228 - DNA, 21 bp, Homo Sapiens
  primer_bind 1..21: downstream amplification primer 99-10618 for SEQ 2363, in complement
aatgtccgaagccatctttcc

SEQ ID NO: 10229 - DNA, 21 bp, Homo Sapiens
  primer_bind 1..21: downstream amplification primer 99-10626 for SEQ 2364, in complement
gcagtatgaattacagagcgg

SEQ ID NO: 10230 - DNA, 21 bp, Homo Sapiens
  primer_bind 1..21: downstream amplification primer 99-10630 for SEQ 2365, in complement
ctcattcaatctgctgtatgg

SEQ ID NO: 10231 - DNA, 18 bp, Homo Sapiens
  primer_bind 1..18: downstream amplification primer 99-10632 for SEQ 2366, in complement
ttttgtccctattgcccc

SEQ ID NO: 10232 - DNA, 21 bp, Homo Sapiens
  primer_bind 1..21: downstream amplification primer 99-10634 for SEQ 2367, in complement
caagctgagaacaaaagcaac

SEQ ID NO: 10233 - DNA, 19 bp, Homo Sapiens
  primer_bind 1..19: downstream amplification primer 99-10643 for SEQ 2368, in complement
atgtgggttgtgtctggtc

SEQ ID NO: 10234 - DNA, 21 bp, Homo Sapiens
  primer_bind 1..21: downstream amplification primer 99-10659 for SEQ 2369, in complement
agttcaccatcttttttgccc

SEQ ID NO: 10235 - DNA, 20 bp, Homo Sapiens
  primer_bind 1..20: downstream amplification primer 99-10661 for SEQ 2370, in complement
ttcacccacgaaaacgagac

SEQ ID NO: 10236 - DNA, 18 bp, Homo Sapiens
  primer_bind 1..18: downstream amplification primer 99-10662 for SEQ 2371, in complement
ggtggagctacaaagaag

SEQ ID NO: 10237 - DNA, 19 bp, Homo Sapiens
  primer_bind 1..19: downstream amplification primer 99-10667 for SEQ 2372, in complement
actgctgataacgaccctc

SEQ ID NO: 10238 - DNA, 20 bp, Homo Sapiens
  primer_bind 1..20: downstream amplification primer 99-10675 for SEQ 2373, in complement
cgaaacagtattttgtagag

SEQ ID NO: 10239 - DNA, 20 bp, Homo Sapiens
  primer_bind 1..20: downstream amplification primer 99-1068 for SEQ 2374, in complement
tttcatcctcacaatgacac

SEQ ID NO: 10240 - DNA, 19 bp, Homo Sapiens
  primer_bind 1..19: downstream amplification primer 99-10683 for SEQ 2375, in complement
catgacagagaataggtgg

SEQ ID NO: 10241 - DNA, 21 bp, Homo Sapiens
  primer_bind 1..21: downstream amplification primer 99-10689 for SEQ 2376, in complement
ctttctcttctttcacaatcc

SEQ ID NO: 10242 - DNA, 19 bp, Homo Sapiens
  primer_bind 1..19: downstream amplification primer 99-10692 for SEQ 2377, in complement
aagaaggtagagaatatgg

SEQ ID NO: 10243 - DNA, 20 bp, Homo Sapiens
  primer_bind 1..20: downstream amplification primer 99-10694 for SEQ 2378, in complement
tctcacaccactccctctac

SEQ ID NO: 10244 - DNA, 21 bp, Homo Sapiens
  primer_bind 1..21: downstream amplification primer 99-10695 for SEQ 2379, in complement
ctctctctcttcccttgctac

SEQ ID NO: 10245 - DNA, 21 bp, Homo Sapiens
  primer_bind 1..21: downstream amplification primer 99-1070 for SEQ 2380, in complement
tcatccttggtcagcacactc

SEQ ID NO: 10246 - DNA, 21 bp, Homo Sapiens
  primer_bind 1..21: downstream amplification primer 99-10702 for SEQ 2381, in complement
agcaatgaacagtagtttgtg

SEQ ID NO: 10247 - DNA, 20 bp, Homo Sapiens
  primer_bind 1..20: downstream amplification primer 99-10706 for SEQ 2382, in complement
agtcaagtatgtaaaggtgg

SEQ ID NO: 10248 - DNA, 21 bp, Homo Sapiens
  primer_bind 1..21: downstream amplification primer 99-10708 for SEQ 2383, in complement
atctcatcttccatccagttc

SEQ ID NO: 10249 - DNA, 21 bp, Homo Sapiens
  primer_bind 1..21: downstream amplification primer 99-10709 for SEQ 2384, in complement
ttcttcccaaaaatatgtgtg

SEQ ID NO: 10250 - DNA, 21 bp, Homo Sapiens
  primer_bind 1..21: downstream amplification primer 99-10715 for SEQ 2385, in complement
tgttcagcaaatatacttctc

SEQ ID NO: 10251 - DNA, 21 bp, Homo Sapiens
  primer_bind 1..21: downstream amplification primer 99-10719 for SEQ 2386, in complement
aaactctttacaactcttctc

SEQ ID NO: 10252 - DNA, 18 bp, Homo Sapiens
  primer_bind 1..18: downstream amplification primer 99-10720 for SEQ 2387, in complement
gttacgccaatcacaaag

SEQ ID NO: 10253 - DNA, 21 bp, Homo Sapiens
  primer_bind 1..21: downstream amplification primer 99-10731 for SEQ 2388, in complement
ggaaatcaaggaacaacacac

SEQ ID NO: 10254 - DNA, 19 bp, Homo Sapiens
  primer_bind 1..19: downstream amplification primer 99-10735 for SEQ 2389, in complement
attctacacacaccaattc

SEQ ID NO: 10255 - DNA, 19 bp, Homo Sapiens
  primer_bind 1..19: downstream amplification primer 99-1074 for SEQ 2390, in complement
gagtgtgtaataaaagagg

SEQ ID NO: 10256 - DNA, 21 bp, Homo Sapiens
  primer_bind 1..21: downstream amplification primer 99-10741 for SEQ 2391, in complement
aaccacgtagtgtgtatagag

SEQ ID NO: 10257 - DNA, 21 bp, Homo Sapiens
  primer_bind 1..21: downstream amplification primer 99-10743 for SEQ 2392, in complement
ataattcactgtcatatctgg

SEQ ID NO: 10258 - DNA, 21 bp, Homo Sapiens
  primer_bind 1..21: downstream amplification primer 99-1075 for SEQ 2393, in complement
ataccacagcattaggatcac

SEQ ID NO: 10259 - DNA, 21 bp, Homo Sapiens
  primer_bind 1..21: downstream amplification primer 99-10752 for SEQ 2394, in complement
ttagtagccagaacgaaggag

SEQ ID NO: 10260 - DNA, 18 bp, Homo Sapiens
  primer_bind 1..18: downstream amplification primer 99-1076 for SEQ 2395, in complement
gactaaaagccttcactc

SEQ ID NO: 10261 - DNA, 21 bp, Homo Sapiens
  primer_bind 1..21: downstream amplification primer 99-10769 for SEQ 2396, in complement
gtgtttatatttagctgtgtg

SEQ ID NO: 10262 - DNA, 20 bp, Homo Sapiens
  primer_bind 1..20: downstream amplification primer 99-10771 for SEQ 2397, in complement
agagtagactttgaagatgg

SEQ ID NO: 10263 - DNA, 19 bp, Homo Sapiens
  primer_bind 1..19: downstream amplification primer 99-10775 for SEQ 2398, in complement
caagaccatagatttggag

SEQ ID NO: 10264 - DNA, 21 bp, Homo Sapiens
  primer_bind 1..21: downstream amplification primer 99-10776 for SEQ 2399, in complement
actaggagttcttaatctgtg

SEQ ID NO: 10265 - DNA, 19 bp, Homo Sapiens
  primer_bind 1..19: downstream amplification primer 99-1079 for SEQ 2400, in complement
ctatgtttgtgaccctacc

SEQ ID NO: 10266 - DNA, 21 bp, Homo Sapiens
  primer_bind 1..21: downstream amplification primer 99-1081 for SEQ 2401, in complement
cagccaaacagttctgagtcc

SEQ ID NO: 10267 - DNA, 21 bp, Homo Sapiens
  primer_bind 1..21: downstream amplification primer 99-10816 for SEQ 2402, in complement
ctaaccttcctttactggcac

SEQ ID NO: 10268 - DNA, 21 bp, Homo Sapiens
  primer_bind 1..21: downstream amplification primer 99-1082 for SEQ 2403, in complement
ctgatttgattggaagctagg

SEQ ID NO: 10269 - DNA, 21 bp, Homo Sapiens
  primer_bind 1..21: downstream amplification primer 99-10839 for SEQ 2404, in complement
ttaggaataatttgatgaggg

SEQ ID NO: 10270 - DNA, 21 bp, Homo Sapiens
  primer_bind 1..21: downstream amplification primer 99-10842 for SEQ 2405, in complement
tgccccttccatttttcttcc

SEQ ID NO: 10271 - DNA, 21 bp, Homo Sapiens
  primer_bind 1..21: downstream amplification primer 99-10843 for SEQ 2406, in complement
tattttccaactgaccaaagc

SEQ ID NO: 10272 - DNA, 21 bp, Homo Sapiens
  primer_bind 1..21: downstream amplification primer 99-10856 for SEQ 2407, in complement
aacatatagaggaggaatctg

SEQ ID NO: 10273 - DNA, 21 bp, Homo Sapiens
  primer_bind 1..21: downstream amplification primer 99-10861 for SEQ 2408, in complement
tctgtagtctgttagtggtgg

SEQ ID NO: 10274 - DNA, 21 bp, Homo Sapiens
  primer_bind 1..21: downstream amplification primer 99-10862 for SEQ 2409, in complement
gagtcactttcagtcatttcc

SEQ ID NO: 10275 - DNA, 21 bp, Homo Sapiens
  primer_bind 1..21: downstream amplification primer 99-10864 for SEQ 2410, in complement
ttgggggagaattgagaggag

SEQ ID NO: 10276 - DNA, 18 bp, Homo Sapiens
  primer_bind 1..18: downstream amplification primer 99-10870 for SEQ 2411, in complement
ctataagatgtgacaggg

SEQ ID NO: 10277 - DNA, 21 bp, Homo Sapiens
  primer_bind 1..21: downstream amplification primer 99-10874 for SEQ 2412, in complement
aacttcggtctttgggcactc

SEQ ID NO: 10278 - DNA, 21 bp, Homo Sapiens
  primer_bind 1..21: downstream amplification primer 99-10879 for SEQ 2413, in complement
tcaccaaactttatccattcc

SEQ ID NO: 10279 - DNA, 20 bp, Homo Sapiens
  primer_bind 1..20: downstream amplification primer 99-10887 for SEQ 2414, in complement
tcggtggtgatggtgaagac

SEQ ID NO: 10280 - DNA, 21 bp, Homo Sapiens
  primer_bind 1..21: downstream amplification primer 99-10890 for SEQ 2415, in complement
cttgctcaaaacattctgtgg

SEQ ID NO: 10281 - DNA, 21 bp, Homo Sapiens
  primer_bind 1..21: downstream amplification primer 99-10894 for SEQ 2416, in complement
aaatatgtgagtgagacttgg

SEQ ID NO: 10282 - DNA, 21 bp, Homo Sapiens
  primer_bind 1..21: downstream amplification primer 99-10898 for SEQ 2417, in complement
tgaacccttcttggtgtgttg

SEQ ID NO: 10283 - DNA, 20 bp, Homo Sapiens
  primer_bind 1..20: downstream amplification primer 99-10904 for SEQ 2418, in complement
gcccctcaaacttggatgtg

SEQ ID NO: 10284 - DNA, 21 bp, Homo Sapiens
  primer_bind 1..21: downstream amplification primer 99-10905 for SEQ 2419, in complement
tgtctacttgatctgtcatgg

SEQ ID NO: 10285 - DNA, 21 bp, Homo Sapiens
  primer_bind 1..21: downstream amplification primer 99-1091 for SEQ 2420, in complement
aagtaaatggtttgagggatg

SEQ ID NO: 10286 - DNA, 21 bp, Homo Sapiens
  primer_bind 1..21: downstream amplification primer 99-10927 for SEQ 2421, in complement
cttcagtcatttcttctctac

SEQ ID NO: 10287 - DNA, 21 bp, Homo Sapiens
  primer_bind 1..21: downstream amplification primer 99-10929 for SEQ 2422, in complement
ctcgaagttttaatactttcc

SEQ ID NO: 10288 - DNA, 21 bp, Homo Sapiens
  primer_bind 1..21: downstream amplification primer 99-10930 for SEQ 2423, in complement
atttagtgctggaaaattagg

SEQ ID NO: 10289 - DNA, 21 bp, Homo Sapiens
  primer_bind 1..21: downstream amplification primer 99-10937 for SEQ 2424, in complement
ggtatctaaacttctcatatc

SEQ ID NO: 10290 - DNA, 21 bp, Homo Sapiens
  primer_bind 1..21: downstream amplification primer 99-10944 for SEQ 2425, in complement
atgaagggtaagaggaatgtg

SEQ ID NO: 10291 - DNA, 21 bp, Homo Sapiens
  primer_bind 1..21: downstream amplification primer 99-10951 for SEQ 2426, in complement
aatgtcttagcagcaggaagg

SEQ ID NO: 10292 - DNA, 21 bp, Homo Sapiens
  primer_bind 1..21: downstream amplification primer 99-10959 for SEQ 2427, in complement
gaaaccacaagaagtttgacc

SEQ ID NO: 10293 - DNA, 21 bp, Homo Sapiens
  primer_bind 1..21: downstream amplification primer 99-10964 for SEQ 2428, in complement
ctaaacctatcaaacactgac

SEQ ID NO: 10294 - DNA, 21 bp, Homo Sapiens
  primer_bind 1..21: downstream amplification primer 99-10965 for SEQ 2429, in complement
aagtatgtggatgttttgtgg

SEQ ID NO: 10295 - DNA, 19 bp, Homo Sapiens
  primer_bind 1..19: downstream amplification primer 99-10966 for SEQ 2430, in complement
ctgccatgaccaaagaaac

SEQ ID NO: 10296 - DNA, 21 bp, Homo Sapiens
  primer_bind 1..21: downstream amplification primer 99-10974 for SEQ 2431, in complement
tgctgtgagaaaaattagatg

SEQ ID NO: 10297 - DNA, 21 bp, Homo Sapiens
  primer_bind 1..21: downstream amplification primer 99-10978 for SEQ 2432, in complement
atttttaggcttttccttacg

SEQ ID NO: 10298 - DNA, 20 bp, Homo Sapiens
  primer_bind 1..20: downstream amplification primer 99-10979 for SEQ 2433, in complement
gaaagaaaatggatagatgg

SEQ ID NO: 10299 - DNA, 21 bp, Homo Sapiens
  primer_bind 1..21: downstream amplification primer 99-10988 for SEQ 2434, in complement
gggaagatgaggtaatttggg

SEQ ID NO: 10300 - DNA, 21 bp, Homo Sapiens
  primer_bind 1..21: downstream amplification primer 99-10992 for SEQ 2435, in complement
tttctttctatccaccaactc

SEQ ID NO: 10301 - DNA, 20 bp, Homo Sapiens
  primer_bind 1..20: downstream amplification primer 99-11000 for SEQ 2436, in complement
gaatgtagcctaaatgaatg

SEQ ID NO: 10302 - DNA, 21 bp, Homo Sapiens
  primer_bind 1..21: downstream amplification primer 99-11001 for SEQ 2437, in complement
aaaacctaatctcaaagacac

SEQ ID NO: 10303 - DNA, 21 bp, Homo Sapiens
  primer_bind 1..21: downstream amplification primer 99-11003 for SEQ 2438, in complement
ttaagggaacaagggagtgtc

SEQ ID NO: 10304 - DNA, 19 bp, Homo Sapiens
  primer_bind 1..19: downstream amplification primer 99-11006 for SEQ 2439, in complement
tgagcaatttgttctttcc

SEQ ID NO: 10305 - DNA, 21 bp, Homo Sapiens
  primer_bind 1..21: downstream amplification primer 99-11007 for SEQ 2440, in complement
acctccctgtaaatgagatgc

SEQ ID NO: 10306 - DNA, 21 bp, Homo Sapiens
  primer_bind 1..21: downstream amplification primer 99-11014 for SEQ 2441, in complement
cagaatgggaaggaataagac

SEQ ID NO: 10307 - DNA, 21 bp, Homo Sapiens
  primer_bind 1..21: downstream amplification primer 99-11034 for SEQ 2442, in complement
catagcaaaattcacttttcc

SEQ ID NO: 10308 - DNA, 21 bp, Homo Sapiens
  primer_bind 1..21: downstream amplification primer 99-11035 for SEQ 2443, in complement
atctccaaaaaatccaaaacc

SEQ ID NO: 10309 - DNA, 19 bp, Homo Sapiens
  primer_bind 1..19: downstream amplification primer 99-11037 for SEQ 2444, in complement
gacaccagacattttatac

SEQ ID NO: 10310 - DNA, 21 bp, Homo Sapiens
  primer_bind 1..21: downstream amplification primer 99-1105 for SEQ 2445, in complement
aaaatacaaacactgctatgg

SEQ ID NO: 10311 - DNA, 21 bp, Homo Sapiens
  primer_bind 1..21: downstream amplification primer 99-11051 for SEQ 2446, in complement
agataggaaaaagtgtgaagg

SEQ ID NO: 10312 - DNA, 20 bp, Homo Sapiens
  primer_bind 1..20: downstream amplification primer 99-11063 for SEQ 2447, in complement
aagtgtggttgggtataaag

SEQ ID NO: 10313 - DNA, 21 bp, Homo Sapiens
  primer_bind 1..21: downstream amplification primer 99-11074 for SEQ 2448, in complement
aactatccctgaaaaatgttg

SEQ ID NO: 10314 - DNA, 21 bp, Homo Sapiens
  primer_bind 1..21: downstream amplification primer 99-11075 for SEQ 2449, in complement
tttctaattccctttcttgac

SEQ ID NO: 10315 - DNA, 21 bp, Homo Sapiens
  primer_bind 1..21: downstream amplification primer 99-11089 for SEQ 2450, in complement
cggaagatttcacaggatgac

SEQ ID NO: 10316 - DNA, 18 bp, Homo Sapiens
  primer_bind 1..18: downstream amplification primer 99-11094 for SEQ 2451, in complement
ggtgatgaggatagaatg

SEQ ID NO: 10317 - DNA, 21 bp, Homo Sapiens
  primer_bind 1..21: downstream amplification primer 99-11099 for SEQ 2452, in complement
gtattcaaaccagttcaaatc

SEQ ID NO: 10318 - DNA, 21 bp, Homo Sapiens
  primer_bind 1..21: downstream amplification primer 99-11103 for SEQ 2453, in complement
ggacagccgtagatattaaag

SEQ ID NO: 10319 - DNA, 20 bp, Homo Sapiens
  primer_bind 1..20: downstream amplification primer 99-11106 for SEQ 2454, in complement
atggttggggtgtgagagtg

SEQ ID NO: 10320 - DNA, 21 bp, Homo Sapiens
  primer_bind 1..21: downstream amplification primer 99-11110 for SEQ 2455, in complement
gccccaccaaaaatacataag

SEQ ID NO: 10321 - DNA, 19 bp, Homo Sapiens
  primer_bind 1..19: downstream amplification primer 99-11115 for SEQ 2456, in complement
ctttgtttttgatgatgcc

SEQ ID NO: 10322 - DNA, 21 bp, Homo Sapiens
  primer_bind 1..21: downstream amplification primer 99-11119 for SEQ 2457, in complement
atttcatagggtttgttgtag

SEQ ID NO: 10323 - DNA, 21 bp, Homo Sapiens
  primer_bind 1..21: downstream amplification primer 99-11128 for SEQ 2458, in complement
agtcagcagaggtttccatag

SEQ ID NO: 10324 - DNA, 20 bp, Homo Sapiens
  primer_bind 1..20: downstream amplification primer 99-11136 for SEQ 2459, in complement
ttccttaaatgagggaagac

SEQ ID NO: 10325 - DNA, 18 bp, Homo Sapiens
  primer_bind 1..18: downstream amplification primer 99-11142 for SEQ 2460, in complement
cctctctcctattcaacc

SEQ ID NO: 10326 - DNA, 19 bp, Homo Sapiens
  primer_bind 1..19: downstream amplification primer 99-11143 for SEQ 2461, in complement
atatcagaagtagagtcag

SEQ ID NO: 10327 - DNA, 21 bp, Homo Sapiens
  primer_bind 1..21: downstream amplification primer 99-11144 for SEQ 2462, in complement
gacagctatgataacctctgg

SEQ ID NO: 10328 - DNA, 20 bp, Homo Sapiens
  primer_bind 1..20: downstream amplification primer 99-11148 for SEQ 2463, in complement
tggggtctccttggaacatc

SEQ ID NO: 10329 - DNA, 21 bp, Homo Sapiens
  primer_bind 1..21: downstream amplification primer 99-11158 for SEQ 2464, in complement
gtgctcatgcaacacttgttc

SEQ ID NO: 10330 - DNA, 21 bp, Homo Sapiens
  primer_bind 1..21: downstream amplification primer 99-11163 for SEQ 2465, in complement
tcttcctggtctatcaatgtc

SEQ ID NO: 10331 - DNA, 21 bp, Homo Sapiens
  primer_bind 1..21: downstream amplification primer 99-11164 for SEQ 2466, in complement
tcctatgtctttttctctatg

SEQ ID NO: 10332 - DNA, 21 bp, Homo Sapiens
  primer_bind 1..21: downstream amplification primer 99-11168 for SEQ 2467, in complement
tttaattccctattgaccatc

SEQ ID NO: 10333 - DNA, 21 bp, Homo Sapiens
  primer_bind 1..21: downstream amplification primer 99-11175 for SEQ 2468, in complement
cagacaaatgattcaaatgac

SEQ ID NO: 10334 - DNA, 21 bp, Homo Sapiens
  primer_bind 1..21: downstream amplification primer 99-11179 for SEQ 2469, in complement
ccgagaaagatgtgaaaaacg

SEQ ID NO: 10335 - DNA, 21 bp, Homo Sapiens
  primer_bind 1..21: downstream amplification primer 99-11180 for SEQ 2470, in complement
gaatctcagcgaagttatacc

SEQ ID NO: 10336 - DNA, 21 bp, Homo Sapiens
  primer_bind 1..21: downstream amplification primer 99-11183 for SEQ 2471, in complement
tggtggaatgtgttatttgtg

SEQ ID NO: 10337 - DNA, 21 bp, Homo Sapiens
  primer_bind 1..21: downstream amplification primer 99-11191 for SEQ 2472, in complement
tcaggggaacttacttacagg

SEQ ID NO: 10338 - DNA, 20 bp, Homo Sapiens
  primer_bind 1..20: downstream amplification primer 99-11210 for SEQ 2473, in complement
ctgcatctggagaatgtggc

SEQ ID NO: 10339 - DNA, 19 bp, Homo Sapiens
  primer_bind 1..19: downstream amplification primer 99-11214 for SEQ 2474, in complement
gaagtcgtcatatacctcc

SEQ ID NO: 10340 - DNA, 21 bp, Homo Sapiens
  primer_bind 1..21: downstream amplification primer 99-11218 for SEQ 2475, in complement
tgctacattgtggtgcattgg

SEQ ID NO: 10341 - DNA, 21 bp, Homo Sapiens
  primer_bind 1..21: downstream amplification primer 99-11236 for SEQ 2476, in complement
atctactttccccatctccac

SEQ ID NO: 10342 - DNA, 19 bp, Homo Sapiens
  primer_bind 1..19: downstream amplification primer 99-11247 for SEQ 2477, in complement
gtaatgtttgagcagacag

SEQ ID NO: 10343 - DNA, 18 bp, Homo Sapiens
  primer_bind 1..18: downstream amplification primer 99-11248 for SEQ 2478, in complement
actaagagacgagactcc

SEQ ID NO: 10344 - DNA, 21 bp, Homo Sapiens
  primer_bind 1..21: downstream amplification primer 99-11252 for SEQ 2479, in complement
gcctcatattctaagaatgcc

SEQ ID NO: 10345 - DNA, 21 bp, Homo Sapiens
  primer_bind 1..21: downstream amplification primer 99-11255 for SEQ 2480, in complement
aacctgtctttaggaggtctg

SEQ ID NO: 10346 - DNA, 21 bp, Homo Sapiens
  primer_bind 1..21: downstream amplification primer 99-11260 for SEQ 2481, in complement
aggtgcagtgaggttaaggag

SEQ ID NO: 10347 - DNA, 21 bp, Homo Sapiens
  primer_bind 1..21: downstream amplification primer 99-11261 for SEQ 2482, in complement
cagttaatggtgttgggaatc

SEQ ID NO: 10348 - DNA, 20 bp, Homo Sapiens
  primer_bind 1..20: downstream amplification primer 99-11293 for SEQ 2483, in complement
gagtccagggatcagtcaag

SEQ ID NO: 10349 - DNA, 20 bp, Homo Sapiens
  primer_bind 1..20: downstream amplification primer 99-11313 for SEQ 2484, in complement
gtacacatcctggatttcac

SEQ ID NO: 10350 - DNA, 21 bp, Homo Sapiens
  primer_bind 1..21: downstream amplification primer 99-11320 for SEQ 2485, in complement
gtctggaaagagagggagatg

SEQ ID NO: 10351 - DNA, 21 bp, Homo Sapiens
  primer_bind 1..21: downstream amplification primer 99-11326 for SEQ 2486, in complement
cttactacaaaatgtgcctcc

SEQ ID NO: 10352 - DNA, 21 bp, Homo Sapiens
  primer_bind 1..21: downstream amplification primer 99-11340 for SEQ 2487, in complement
tccagggtgcttcaacaacag

SEQ ID NO: 10353 - DNA, 21 bp, Homo Sapiens
  primer_bind 1..21: downstream amplification primer 99-11346 for SEQ 2488, in complement
tgctaaaatgtttatcgtgcc

SEQ ID NO: 10354 - DNA, 19 bp, Homo Sapiens
  primer_bind 1..19: downstream amplification primer 99-11350 for SEQ 2489, in complement
tctcgttcacggtaagtgc

SEQ ID NO: 10355 - DNA, 21 bp, Homo Sapiens
  primer_bind 1..21: downstream amplification primer 99-11356 for SEQ 2490, in complement
caaaattggggcttagcatgg

SEQ ID NO: 10356 - DNA, 21 bp, Homo Sapiens
  primer_bind 1..21: downstream amplification primer 99-11362 for SEQ 2491, in complement
tgactgttatgccctaatacc

SEQ ID NO: 10357 - DNA, 21 bp, Homo Sapiens
  primer_bind 1..21: downstream amplification primer 99-11369 for SEQ 2492, in complement
tcataatgagacccctgaaac

SEQ ID NO: 10358 - DNA, 21 bp, Homo Sapiens
  primer_bind 1..21: downstream amplification primer 99-11372 for SEQ 2493, in complement
gggaatctaatcattgcagag

SEQ ID NO: 10359 - DNA, 21 bp, Homo Sapiens
  primer_bind 1..21: downstream amplification primer 99-11377 for SEQ 2494, in complement
ggagttccctccttactcttg

SEQ ID NO: 10360 - DNA, 19 bp, Homo Sapiens
  primer_bind 1..19: downstream amplification primer 99-11381 for SEQ 2495, in complement
ccatctcaaccatcactac

SEQ ID NO: 10361 - DNA, 21 bp, Homo Sapiens
  primer_bind 1..21: downstream amplification primer 99-11385 for SEQ 2496, in complement
tacttctttcagagagagagg

SEQ ID NO: 10362 - DNA, 21 bp, Homo Sapiens
  primer_bind 1..21: downstream amplification primer 99-11413 for SEQ 2497, in complement
gtgaggggggaaaatagtagg

SEQ ID NO: 10363 - DNA, 18 bp, Homo Sapiens
  primer_bind 1..18: downstream amplification primer 99-1143 for SEQ 2498, in complement
taccttagtaagtggctg

SEQ ID NO: 10364 - DNA, 21 bp, Homo Sapiens
  primer_bind 1..21: downstream amplification primer 99-11430 for SEQ 2499, in complement
agtgagagaattgaatgttgg

SEQ ID NO: 10365 - DNA, 21 bp, Homo Sapiens
  primer_bind 1..21: downstream amplification primer 99-11431 for SEQ 2500, in complement
tcatacacattccctgtcttc

SEQ ID NO: 10366 - DNA, 20 bp, Homo Sapiens
  primer_bind 1..20: downstream amplification primer 99-11449 for SEQ 2501, in complement
ggggacttggctaaactctg

SEQ ID NO: 10367 - DNA, 21 bp, Homo Sapiens
  primer_bind 1..21: downstream amplification primer 99-11464 for SEQ 2502, in complement
aaccccatttctgttgtccac

SEQ ID NO: 10368 - DNA, 20 bp, Homo Sapiens
  primer_bind 1..20: downstream amplification primer 99-11466 for SEQ 2503, in complement
cctcaaatatacctcaaaac

SEQ ID NO: 10369 - DNA, 21 bp, Homo Sapiens
  primer_bind 1..21: downstream amplification primer 99-11485 for SEQ 2504, in complement
acaagtgaattgaatctgccc

SEQ ID NO: 10370 - DNA, 19 bp, Homo Sapiens
  primer_bind 1..19: downstream amplification primer 99-11492 for SEQ 2505, in complement
actgtcatgggtcaccttc

SEQ ID NO: 10371 - DNA, 21 bp, Homo Sapiens
  primer_bind 1..21: downstream amplification primer 99-11499 for SEQ 2506, in complement
ctacctaatctgttaccaacc

SEQ ID NO: 10372 - DNA, 21 bp, Homo Sapiens
  primer_bind 1..21: downstream amplification primer 99-11505 for SEQ 2507, in complement
ttggggcaaactgctattatc

SEQ ID NO: 10373 - DNA, 21 bp, Homo Sapiens
  primer_bind 1..21: downstream amplification primer 99-11506 for SEQ 2508, in complement
gttgtgggtaattttctgtgg

SEQ ID NO: 10374 - DNA, 20 bp, Homo Sapiens
  primer_bind 1..20: downstream amplification primer 99-11520 for SEQ 2509, in complement
tgcacccacaaaaccaaccc

SEQ ID NO: 10375 - DNA, 21 bp, Homo Sapiens
  primer_bind 1..21: downstream amplification primer 99-11521 for SEQ 2510, in complement
aggatgaggactaggaatatg

SEQ ID NO: 10376 - DNA, 21 bp, Homo Sapiens
  primer_bind 1..21: downstream amplification primer 99-11522 for SEQ 2511, in complement
ttcacacataatctctttggg

SEQ ID NO: 10377 - DNA, 21 bp, Homo Sapiens
  primer_bind 1..21: downstream amplification primer 99-11528 for SEQ 2512, in complement
aagtatggtttttggggtgag

SEQ ID NO: 10378 - DNA, 19 bp, Homo Sapiens
  primer_bind 1..19: downstream amplification primer 99-11530 for SEQ 2513, in complement
accatctttttcatctacc

SEQ ID NO: 10379 - DNA, 21 bp, Homo Sapiens
  primer_bind 1..21: downstream amplification primer 99-11533 for SEQ 2514, in complement
atgttcatctatgccaacctc

SEQ ID NO: 10380 - DNA, 21 bp, Homo Sapiens
  primer_bind 1..21: downstream amplification primer 99-11535 for SEQ 2515, in complement
aatgtgaaacatccactctcc

SEQ ID NO: 10381 - DNA, 20 bp, Homo Sapiens
  primer_bind 1..20: downstream amplification primer 99-11543 for SEQ 2516, in complement
tctcctaagtcttgctaaac

SEQ ID NO: 10382 - DNA, 21 bp, Homo Sapiens
  primer_bind 1..21: downstream amplification primer 99-11545 for SEQ 2517, in complement
agccatcgtcagccattagtc

SEQ ID NO: 10383 - DNA, 20 bp, Homo Sapiens
  primer_bind 1..20: downstream amplification primer 99-11555 for SEQ 2518, in complement
acggaacagaacaggacagg

SEQ ID NO: 10384 - DNA, 19 bp, Homo Sapiens
  primer_bind 1..19: downstream amplification primer 99-11559 for SEQ 2519, in complement
taagctggggttatggggc

SEQ ID NO: 10385 - DNA, 21 bp, Homo Sapiens
  primer_bind 1..21: downstream amplification primer 99-11563 for SEQ 2520, in complement
tatatgtattgggcgactagg

SEQ ID NO: 10386 - DNA, 21 bp, Homo Sapiens
  primer_bind 1..21: downstream amplification primer 99-11565 for SEQ 2521, in complement
ttattcatagaaaaggcaagc

SEQ ID NO: 10387 - DNA, 21 bp, Homo Sapiens
  primer_bind 1..21: downstream amplification primer 99-11566 for SEQ 2522, in complement
tggttacataacacctgggac

SEQ ID NO: 10388 - DNA, 21 bp, Homo Sapiens
  primer_bind 1..21: downstream amplification primer 99-11580 for SEQ 2523, in complement
gtcttctcagttcaccttctc

SEQ ID NO: 10389 - DNA, 21 bp, Homo Sapiens
  primer_bind 1..21: downstream amplification primer 99-11584 for SEQ 2524, in complement
cggacataaagatggacagac

SEQ ID NO: 10390 - DNA, 20 bp, Homo Sapiens
  primer_bind 1..20: downstream amplification primer 99-11587 for SEQ 2525, in complement
atcccgttcttctgtcgctc

SEQ ID NO: 10391 - DNA, 21 bp, Homo Sapiens
  primer_bind 1..21: downstream amplification primer 99-11592 for SEQ 2526, in complement
aagtcacccttacattttgcc

SEQ ID NO: 10392 - DNA, 19 bp, Homo Sapiens
  primer_bind 1..19: downstream amplification primer 99-11600 for SEQ 2527, in complement
acgtgtgttcccctcaatc

SEQ ID NO: 10393 - DNA, 21 bp, Homo Sapiens
  primer_bind 1..21: downstream amplification primer 99-11601 for SEQ 2528, in complement
tatgacactccaggggactac

SEQ ID NO: 10394 - DNA, 21 bp, Homo Sapiens
  primer_bind 1..21: downstream amplification primer 99-11602 for SEQ 2529, in complement
aaagggagggactaacaaagg

SEQ ID NO: 10395 - DNA, 21 bp, Homo Sapiens
  primer_bind 1..21: downstream amplification primer 99-11604 for SEQ 2530, in complement
cctgctttcaagaaggttatg

SEQ ID NO: 10396 - DNA, 20 bp, Homo Sapiens
  primer_bind 1..20: downstream amplification primer 99-11611 for SEQ 2531, in complement
tcatactcaccacccacacc

SEQ ID NO: 10397 - DNA, 21 bp, Homo Sapiens
  primer_bind 1..21: downstream amplification primer 99-11613 for SEQ 2532, in complement
tatggctactccaaggtcatc

SEQ ID NO: 10398 - DNA, 21 bp, Homo Sapiens
  primer_bind 1..21: downstream amplification primer 99-11620 for SEQ 2533, in complement
tataatgtggggtaagggagg

SEQ ID NO: 10399 - DNA, 21 bp, Homo Sapiens
  primer_bind 1..21: downstream amplification primer 99-11635 for SEQ 2534, in complement
taattggaacttcctcctgtg

SEQ ID NO: 10400 - DNA, 21 bp, Homo Sapiens
  primer_bind 1..21: downstream amplification primer 99-11643 for SEQ 2535, in complement
agttctatatttttccccctc

SEQ ID NO: 10401 - DNA, 21 bp, Homo Sapiens
  primer_bind 1..21: downstream amplification primer 99-11645 for SEQ 2536, in complement
aacagagaccaagaagtcatc

SEQ ID NO: 10402 - DNA, 20 bp, Homo Sapiens
  primer_bind 1..20: downstream amplification primer 99-11658 for SEQ 2537, in complement
tgggagtagaggatagggag

SEQ ID NO: 10403 - DNA, 21 bp, Homo Sapiens
  primer_bind 1..21: downstream amplification primer 99-11668 for SEQ 2538, in complement
ggagtcagttctgattgaggg

SEQ ID NO: 10404 - DNA, 21 bp, Homo Sapiens
  primer_bind 1..21: downstream amplification primer 99-11669 for SEQ 2539, in complement
gacctctgacacatcagtcac

SEQ ID NO: 10405 - DNA, 21 bp, Homo Sapiens
  primer_bind 1..21: downstream amplification primer 99-11670 for SEQ 2540, in complement
ctgaatgtttggagagggagg

SEQ ID NO: 10406 - DNA, 20 bp, Homo Sapiens
  primer_bind 1..20: downstream amplification primer 99-11685 for SEQ 2541, in complement
gccttcaatctcttgcctcg

SEQ ID NO: 10407 - DNA, 21 bp, Homo Sapiens
  primer_bind 1..21: downstream amplification primer 99-11697 for SEQ 2542, in complement
tgtgtttctgttggcaaaagg

SEQ ID NO: 10408 - DNA, 21 bp, Homo Sapiens
  primer_bind 1..21: downstream amplification primer 99-11700 for SEQ 2543, in complement
atcttgcttatccagctttac

SEQ ID NO: 10409 - DNA, 19 bp, Homo Sapiens
  primer_bind 1..19: downstream amplification primer 99-11704 for SEQ 2544, in complement
gctttgctccttccttacc

SEQ ID NO: 10410 - DNA, 21 bp, Homo Sapiens
  primer_bind 1..21: downstream amplification primer 99-11705 for SEQ 2545, in complement
aattcctcttcctccttctcc

SEQ ID NO: 10411 - DNA, 21 bp, Homo Sapiens
  primer_bind 1..21: downstream amplification primer 99-11723 for SEQ 2546, in complement
agaggaagtgaaaaaggagag

SEQ ID NO: 10412 - DNA, 20 bp, Homo Sapiens
  primer_bind 1..20: downstream amplification primer 99-11743 for SEQ 2547, in complement
ttttctgttttcaaccagcc

SEQ ID NO: 10413 - DNA, 21 bp, Homo Sapiens
  primer_bind 1..21: downstream amplification primer 99-11745 for SEQ 2548, in complement
ctcggagtcaagcatactagg

SEQ ID NO: 10414 - DNA, 21 bp, Homo Sapiens
  primer_bind 1..21: downstream amplification primer 99-11746 for SEQ 2549, in complement
aagtatggggttagacctttg

SEQ ID NO: 10415 - DNA, 21 bp, Homo Sapiens
  primer_bind 1..21: downstream amplification primer 99-11780 for SEQ 2550, in complement
tggctcttggaggtaagatgg

SEQ ID NO: 10416 - DNA, 21 bp, Homo Sapiens
  primer_bind 1..21: downstream amplification primer 99-11785 for SEQ 2551, in complement
ttcatctacttcaactccttc

SEQ ID NO: 10417 - DNA, 21 bp, Homo Sapiens
  primer_bind 1..21: downstream amplification primer 99-11786 for SEQ 2552, in complement
agattcagttcgacacaacac

SEQ ID NO: 10418 - DNA, 21 bp, Homo Sapiens
  primer_bind 1..21: downstream amplification primer 99-11787 for SEQ 2553, in complement
tgatgatctgatctgagcagg

SEQ ID NO: 10419 - DNA, 20 bp, Homo Sapiens
  primer_bind 1..20: downstream amplification primer 99-11788 for SEQ 2554, in complement
ctcagcaattaaagacaagg

SEQ ID NO: 10420 - DNA, 21 bp, Homo Sapiens
  primer_bind 1..21: downstream amplification primer 99-11789 for SEQ 2555, in complement
ctctttgtatcattcagggtc

SEQ ID NO: 10421 - DNA, 19 bp, Homo Sapiens
  primer_bind 1..19: downstream amplification primer 99-11797 for SEQ 2556, in complement
cagatgatgtgtcagtcag

SEQ ID NO: 10422 - DNA, 21 bp, Homo Sapiens
  primer_bind 1..21: downstream amplification primer 99-11810 for SEQ 2557, in complement
ggtgaaaggattagtctaagg

SEQ ID NO: 10423 - DNA, 21 bp, Homo Sapiens
  primer_bind 1..21: downstream amplification primer 99-11811 for SEQ 2558, in complement
agaagtgtgagagtcaaagcc

SEQ ID NO: 10424 - DNA, 20 bp, Homo Sapiens
  primer_bind 1..20: downstream amplification primer 99-1182 for SEQ 2559, in complement
ccattcatatttcactccac

SEQ ID NO: 10425 - DNA, 21 bp, Homo Sapiens
  primer_bind 1..21: downstream amplification primer 99-11823 for SEQ 2560, in complement
aaaacccatgagtgtgcagcc

SEQ ID NO: 10426 - DNA, 21 bp, Homo Sapiens
  primer_bind 1..21: downstream amplification primer 99-11824 for SEQ 2561, in complement
ataaatgccagttaggtcaag

SEQ ID NO: 10427 - DNA, 21 bp, Homo Sapiens
  primer_bind 1..21: downstream amplification primer 99-1183 for SEQ 2562, in complement
gaagatacaaatgaccaatac

SEQ ID NO: 10428 - DNA, 20 bp, Homo Sapiens
  primer_bind 1..20: downstream amplification primer 99-11830 for SEQ 2563, in complement
ttttttggaatgggttgagg

SEQ ID NO: 10429 - DNA, 21 bp, Homo Sapiens
  primer_bind 1..21: downstream amplification primer 99-11831 for SEQ 2564, in complement
gaccaggtgggtttattcaag

SEQ ID NO: 10430 - DNA, 20 bp, Homo Sapiens
  primer_bind 1..20: downstream amplification primer 99-11839 for SEQ 2565, in complement
gagaccttgaatttcctttg

SEQ ID NO: 10431 - DNA, 20 bp, Homo Sapiens
  primer_bind 1..20: downstream amplification primer 99-11842 for SEQ 2566, in complement
agtgttggcaagaaggaggg

SEQ ID NO: 10432 - DNA, 18 bp, Homo Sapiens
  primer_bind 1..18: downstream amplification primer 99-1185 for SEQ 2567, in complement
gagaaatgacaccttacc

SEQ ID NO: 10433 - DNA, 21 bp, Homo Sapiens
  primer_bind 1..21: downstream amplification primer 99-11851 for SEQ 2568, in complement
acgtatctcacccttgttctc

SEQ ID NO: 10434 - DNA, 19 bp, Homo Sapiens
  primer_bind 1..19: downstream amplification primer 99-11857 for SEQ 2569, in complement
tcttgcaccctgttgcatc

SEQ ID NO: 10435 - DNA, 21 bp, Homo Sapiens
  primer_bind 1..21: downstream amplification primer 99-1186 for SEQ 2570, in complement
gacattagtcattggatttag

SEQ ID NO: 10436 - DNA, 21 bp, Homo Sapiens
  primer_bind 1..21: downstream amplification primer 99-11861 for SEQ 2571, in complement
ttttgggagaagttggtgatg

SEQ ID NO: 10437 - DNA, 21 bp, Homo Sapiens
  primer_bind 1..21: downstream amplification primer 99-11877 for SEQ 2572, in complement
cttcttctactctgcttaggg

SEQ ID NO: 10438 - DNA, 21 bp, Homo Sapiens
  primer_bind 1..21: downstream amplification primer 99-11880 for SEQ 2573, in complement
caaagaaagaagccgaagtcc

SEQ ID NO: 10439 - DNA, 21 bp, Homo Sapiens
  primer_bind 1..21: downstream amplification primer 99-11882 for SEQ 2574, in complement
atatgctctgaggttgttggg

SEQ ID NO: 10440 - DNA, 21 bp, Homo Sapiens
  primer_bind 1..21: downstream amplification primer 99-11894 for SEQ 2575, in complement
acaaatgccagccattatgcc

SEQ ID NO: 10441 - DNA, 19 bp, Homo Sapiens
  primer_bind 1..19: downstream amplification primer 99-11917 for SEQ 2576, in complement
aacactgtcatttcgtatc

SEQ ID NO: 10442 - DNA, 19 bp, Homo Sapiens
  primer_bind 1..19: downstream amplification primer 99-11922 for SEQ 2577, in complement
gttcgatagtggtaagtgc

SEQ ID NO: 10443 - DNA, 19 bp, Homo Sapiens
  primer_bind 1..19: downstream amplification primer 99-11930 for SEQ 2578, in complement
ctagctctggatcaaggac

SEQ ID NO: 10444 - DNA, 21 bp, Homo Sapiens
  primer_bind 1..21: downstream amplification primer 99-11966 for SEQ 2579, in complement
tgacccagttagaccctttcc

SEQ ID NO: 10445 - DNA, 21 bp, Homo Sapiens
  primer_bind 1..21: downstream amplification primer 99-11989 for SEQ 2580, in complement
tcaattttctctgtcaccagc

SEQ ID NO: 10446 - DNA, 20 bp, Homo Sapiens
  primer_bind 1..20: downstream amplification primer 99-11993 for SEQ 2581, in complement
gtaatagtttatgtgtaggg

SEQ ID NO: 10447 - DNA, 21 bp, Homo Sapiens
  primer_bind 1..21: downstream amplification primer 99-12000 for SEQ 2582, in complement
ctcaattcccagattgcaccc

SEQ ID NO: 10448 - DNA, 21 bp, Homo Sapiens
  primer_bind 1..21: downstream amplification primer 99-12005 for SEQ 2583, in complement
ttaggaaagttcattcaagag

SEQ ID NO: 10449 - DNA, 19 bp, Homo Sapiens
  primer_bind 1..19: downstream amplification primer 99-12017 for SEQ 2584, in complement
tctttgaagtattcactgg

SEQ ID NO: 10450 - DNA, 21 bp, Homo Sapiens
  primer_bind 1..21: downstream amplification primer 99-1202 for SEQ 2585, in complement
acttggttcacatcaggggtc

SEQ ID NO: 10451 - DNA, 20 bp, Homo Sapiens
  primer_bind 1..20: downstream amplification primer 99-12028 for SEQ 2586, in complement
aaaagcattggctacatctg

SEQ ID NO: 10452 - DNA, 18 bp, Homo Sapiens
  primer_bind 1..18: downstream amplification primer 99-1203 for SEQ 2587, in complement
cagaactttgtccatcag

SEQ ID NO: 10453 - DNA, 21 bp, Homo Sapiens
  primer_bind 1..21: downstream amplification primer 99-12038 for SEQ 2588, in complement
atttcctccagatggaaggac

SEQ ID NO: 10454 - DNA, 21 bp, Homo Sapiens
  primer_bind 1..21: downstream amplification primer 99-12039 for SEQ 2589, in complement
taagaggataatcagtgccag

SEQ ID NO: 10455 - DNA, 21 bp, Homo Sapiens
  primer_bind 1..21: downstream amplification primer 99-12048 for SEQ 2590, in complement
gtactttgataatagccaccc

SEQ ID NO: 10456 - DNA, 21 bp, Homo Sapiens
  primer_bind 1..21: downstream amplification primer 99-12049 for SEQ 2591, in complement
tcctccttacggctttatctg

SEQ ID NO: 10457 - DNA, 21 bp, Homo Sapiens
  primer_bind 1..21: downstream amplification primer 99-12050 for SEQ 2592, in complement
tcatcttctctctaaaacccc

SEQ ID NO: 10458 - DNA, 21 bp, Homo Sapiens
  primer_bind 1..21: downstream amplification primer 99-12061 for SEQ 2593, in complement
ggatattttacttgggggttc

SEQ ID NO: 10459 - DNA, 21 bp, Homo Sapiens
  primer_bind 1..21: downstream amplification primer 99-12062 for SEQ 2594, in complement
gtagggctaataaatggcagg

SEQ ID NO: 10460 - DNA, 21 bp, Homo Sapiens
  primer_bind 1..21: downstream amplification primer 99-12068 for SEQ 2595, in complement
tgttgtgtgtctcaatgtctc

SEQ ID NO: 10461 - DNA, 21 bp, Homo Sapiens
  primer_bind 1..21: downstream amplification primer 99-12087 for SEQ 2596, in complement
tgtcatagggaaataatagtg

SEQ ID NO: 10462 - DNA, 18 bp, Homo Sapiens
  primer_bind 1..18: downstream amplification primer 99-1211 for SEQ 2597, in complement
gggcactggctggttaag

SEQ ID NO: 10463 - DNA, 21 bp, Homo Sapiens
  primer_bind 1..21: downstream amplification primer 99-12130 for SEQ 2598, in complement
ccttcaggtcaaccttcaatc

SEQ ID NO: 10464 - DNA, 21 bp, Homo Sapiens
  primer_bind 1..21: downstream amplification primer 99-12133 for SEQ 2599, in complement
tactgactccttgacacattg

SEQ ID NO: 10465 - DNA, 21 bp, Homo Sapiens
  primer_bind 1..21: downstream amplification primer 99-12135 for SEQ 2600, in complement
gtcttgttagaggcttctttg

SEQ ID NO: 10466 - DNA, 20 bp, Homo Sapiens
  primer_bind 1..20: downstream amplification primer 99-12152 for SEQ 2601, in complement
gacaatctttcagagcttag

SEQ ID NO: 10467 - DNA, 21 bp, Homo Sapiens
  primer_bind 1..21: downstream amplification primer 99-12158 for SEQ 2602, in complement
ctgacaatgatatacactgcc

SEQ ID NO: 10468 - DNA, 19 bp, Homo Sapiens
  primer_bind 1..19: downstream amplification primer 99-12168 for SEQ 2603, in complement
atcagcactccccactttc

SEQ ID NO: 10469 - DNA, 20 bp, Homo Sapiens
  primer_bind 1..20: downstream amplification primer 99-12171 for SEQ 2604, in complement
cctgatctctgtcttctccc

SEQ ID NO: 10470 - DNA, 21 bp, Homo Sapiens
  primer_bind 1..21: downstream amplification primer 99-12178 for SEQ 2605, in complement
aataggagccctcttttacac

SEQ ID NO: 10471 - DNA, 21 bp, Homo Sapiens
  primer_bind 1..21: downstream amplification primer 99-12181 for SEQ 2606, in complement
gaaagaggcaaaaattgacag

SEQ ID NO: 10472 - DNA, 21 bp, Homo Sapiens
  primer_bind 1..21: downstream amplification primer 99-12186 for SEQ 2607, in complement
tttaccacgccagcagttttc

SEQ ID NO: 10473 - DNA, 21 bp, Homo Sapiens
  primer_bind 1..21: downstream amplification primer 99-12198 for SEQ 2608, in complement
cagtacagtatctggttcatc

SEQ ID NO: 10474 - DNA, 21 bp, Homo Sapiens
  primer_bind 1..21: downstream amplification primer 99-12199 for SEQ 2609, in complement
tgtatgtgggtagagttggtc

SEQ ID NO: 10475 - DNA, 18 bp, Homo Sapiens
  primer_bind 1..18: downstream amplification primer 99-12203 for SEQ 2610, in complement
agctgctgtatagagtcc

SEQ ID NO: 10476 - DNA, 21 bp, Homo Sapiens
  primer_bind 1..21: downstream amplification primer 99-12224 for SEQ 2611, in complement
agataccactatgaatggcag

SEQ ID NO: 10477 - DNA, 21 bp, Homo Sapiens
  primer_bind 1..21: downstream amplification primer 99-12228 for SEQ 2612, in complement
gcctctactgtattctattcc

SEQ ID NO: 10478 - DNA, 20 bp, Homo Sapiens
  primer_bind 1..20: downstream amplification primer 99-12241 for SEQ 2613, in complement
tcctcccaacttccaagcag

SEQ ID NO: 10479 - DNA, 21 bp, Homo Sapiens
  primer_bind 1..21: downstream amplification primer 99-12253 for SEQ 2614, in complement
ttgactcaaaaaagaactagg

SEQ ID NO: 10480 - DNA, 21 bp, Homo Sapiens
  primer_bind 1..21: downstream amplification primer 99-12265 for SEQ 2615, in complement
atacccccaaataaagttcag

SEQ ID NO: 10481 - DNA, 21 bp, Homo Sapiens
  primer_bind 1..21: downstream amplification primer 99-12267 for SEQ 2616, in complement
aagatatgctcagagtgtgtc

SEQ ID NO: 10482 - DNA, 21 bp, Homo Sapiens
  primer_bind 1..21: downstream amplification primer 99-12268 for SEQ 2617, in complement
agtagttcttcttcctgggtc

SEQ ID NO: 10483 - DNA, 21 bp, Homo Sapiens
  primer_bind 1..21: downstream amplification primer 99-12270 for SEQ 2618, in complement
ttctcacacgcttagagtttg

SEQ ID NO: 10484 - DNA, 19 bp, Homo Sapiens
  primer_bind 1..19: downstream amplification primer 99-12271 for SEQ 2619, in complement
ttcgccaagtgcaatgcag

SEQ ID NO: 10485 - DNA, 21 bp, Homo Sapiens
  primer_bind 1..21: downstream amplification primer 99-12275 for SEQ 2620, in complement
gatattatgttggtgaagctg

SEQ ID NO: 10486 - DNA, 21 bp, Homo Sapiens
  primer_bind 1..21: downstream amplification primer 99-12299 for SEQ 2621, in complement
catctcgtctaacaacttatc

SEQ ID NO: 10487 - DNA, 21 bp, Homo Sapiens
  primer_bind 1..21: downstream amplification primer 99-12303 for SEQ 2622, in complement
cttctcctacctaactctctg

SEQ ID NO: 10488 - DNA, 21 bp, Homo Sapiens
  primer_bind 1..21: downstream amplification primer 99-12335 for SEQ 2623, in complement
aataatggtttatacgtgcag

SEQ ID NO: 10489 - DNA, 18 bp, Homo Sapiens
  primer_bind 1..18: downstream amplification primer 99-12338 for SEQ 2624, in complement
tttcgagaaggacgagtg

SEQ ID NO: 10490 - DNA, 21 bp, Homo Sapiens
  primer_bind 1..21: downstream amplification primer 99-12344 for SEQ 2625, in complement
acaaaccttccaccaacaacc

SEQ ID NO: 10491 - DNA, 21 bp, Homo Sapiens
  primer_bind 1..21: downstream amplification primer 99-12347 for SEQ 2626, in complement
atcggcaaagaacattagagg

SEQ ID NO: 10492 - DNA, 21 bp, Homo Sapiens
  primer_bind 1..21: downstream amplification primer 99-12348 for SEQ 2627, in complement
ctcttctttttaaccatcttc

SEQ ID NO: 10493 - DNA, 20 bp, Homo Sapiens
  primer_bind 1..20: downstream amplification primer 99-12352 for SEQ 2628, in complement
accttttttttcacccattc

SEQ ID NO: 10494 - DNA, 21 bp, Homo Sapiens
  primer_bind 1..21: downstream amplification primer 99-12356 for SEQ 2629, in complement
ctggaaaggtatgatggactg

SEQ ID NO: 10495 - DNA, 20 bp, Homo Sapiens
  primer_bind 1..20: downstream amplification primer 99-12361 for SEQ 2630, in complement
acacacccaaagccctgtag

SEQ ID NO: 10496 - DNA, 21 bp, Homo Sapiens
  primer_bind 1..21: downstream amplification primer 99-12368 for SEQ 2631, in complement
atacatgaggaaagagaaggg

SEQ ID NO: 10497 - DNA, 21 bp, Homo Sapiens
  primer_bind 1..21: downstream amplification primer 99-12370 for SEQ 2632, in complement
gtcatttcctcacatctcaac

SEQ ID NO: 10498 - DNA, 21 bp, Homo Sapiens
  primer_bind 1..21: downstream amplification primer 99-12384 for SEQ 2633, in complement
ccattaaaaagacacccatac

SEQ ID NO: 10499 - DNA, 21 bp, Homo Sapiens
  primer_bind 1..21: downstream amplification primer 99-12388 for SEQ 2634, in complement
tccatcgacattagaagcaac

SEQ ID NO: 10500 - DNA, 20 bp, Homo Sapiens
  primer_bind 1..20: downstream amplification primer 99-12393 for SEQ 2635, in complement
tcccacctccttgttctctc

SEQ ID NO: 10501 - DNA, 19 bp, Homo Sapiens
  primer_bind 1..19: downstream amplification primer 99-12399 for SEQ 2636, in complement
cttatggtaaaatctgtcc

SEQ ID NO: 10502 - DNA, 18 bp, Homo Sapiens
  primer_bind 1..18: downstream amplification primer 99-12412 for SEQ 2637, in complement
ggggcttaggatttcaac

SEQ ID NO: 10503 - DNA, 21 bp, Homo Sapiens
  primer_bind 1..21: downstream amplification primer 99-12415 for SEQ 2638, in complement
attcaactcaaaaaggtcctc

SEQ ID NO: 10504 - DNA, 21 bp, Homo Sapiens
  primer_bind 1..21: downstream amplification primer 99-12444 for SEQ 2639, in complement
cctggaacattgtttaatgcc

SEQ ID NO: 10505 - DNA, 21 bp, Homo Sapiens
  primer_bind 1..21: downstream amplification primer 99-12465 for SEQ 2640, in complement
ttcataaacttttccactctc

SEQ ID NO: 10506 - DNA, 21 bp, Homo Sapiens
  primer_bind 1..21: downstream amplification primer 99-12468 for SEQ 2641, in complement
atcaccaaatctcacctatcc

SEQ ID NO: 10507 - DNA, 21 bp, Homo Sapiens
  primer_bind 1..21: downstream amplification primer 99-12470 for SEQ 2642, in complement
atttcctcttgcttccttcac

SEQ ID NO: 10508 - DNA, 21 bp, Homo Sapiens
  primer_bind 1..21: downstream amplification primer 99-12522 for SEQ 2643, in complement
aaactcttcccttccttggtc

SEQ ID NO: 10509 - DNA, 21 bp, Homo Sapiens
  primer_bind 1..21: downstream amplification primer 99-12561 for SEQ 2644, in complement
gatacattcagatcacatggg

SEQ ID NO: 10510 - DNA, 21 bp, Homo Sapiens
  primer_bind 1..21: downstream amplification primer 99-12570 for SEQ 2645, in complement
cagccccgcttgtctattttc

SEQ ID NO: 10511 - DNA, 20 bp, Homo Sapiens
  primer_bind 1..20: downstream amplification primer 99-12595 for SEQ 2646, in complement
ttctggattcacacaagtag

SEQ ID NO: 10512 - DNA, 21 bp, Homo Sapiens
  primer_bind 1..21: downstream amplification primer 99-12596 for SEQ 2647, in complement
caggtctatgtttgggtcttc

SEQ ID NO: 10513 - DNA, 21 bp, Homo Sapiens
  primer_bind 1..21: downstream amplification primer 99-12598 for SEQ 2648, in complement
caccccttcatatttagtccc

SEQ ID NO: 10514 - DNA, 21 bp, Homo Sapiens
  primer_bind 1..21: downstream amplification primer 99-12602 for SEQ 2649, in complement
aattcaacagaggtagagcag

SEQ ID NO: 10515 - DNA, 21 bp, Homo Sapiens
  primer_bind 1..21: downstream amplification primer 99-12605 for SEQ 2650, in complement
gaggtggcttcacttagaatc

SEQ ID NO: 10516 - DNA, 21 bp, Homo Sapiens
  primer_bind 1..21: downstream amplification primer 99-12607 for SEQ 2651, in complement
tagcaacagaagcccaggtag

SEQ ID NO: 10517 - DNA, 19 bp, Homo Sapiens
  primer_bind 1..19: downstream amplification primer 99-12664 for SEQ 2652, in complement
tttcacttgagggcggttg

SEQ ID NO: 10518 - DNA, 21 bp, Homo Sapiens
  primer_bind 1..21: downstream amplification primer 99-12696 for SEQ 2653, in complement
atttggcatcatttcagtgtc

SEQ ID NO: 10519 - DNA, 21 bp, Homo Sapiens
  primer_bind 1..21: downstream amplification primer 99-12960 for SEQ 2654, in complement
tccataaattgccttttcccc

SEQ ID NO: 10520 - DNA, 21 bp, Homo Sapiens
  primer_bind 1..21: downstream amplification primer 99-12965 for SEQ 2655, in complement
tccttagaagtagaatgtttg

SEQ ID NO: 10521 - DNA, 21 bp, Homo Sapiens
  primer_bind 1..21: downstream amplification primer 99-12969 for SEQ 2656, in complement
agcacctactatgtattgctc

SEQ ID NO: 10522 - DNA, 21 bp, Homo Sapiens
  primer_bind 1..21: downstream amplification primer 99-12970 for SEQ 2657, in complement
ttcttgaccaagtgtcttatg

SEQ ID NO: 10523 - DNA, 19 bp, Homo Sapiens
  primer_bind 1..19: downstream amplification primer 99-12973 for SEQ 2658, in complement
ggagagtgacagtgtttag

SEQ ID NO: 10524 - DNA, 21 bp, Homo Sapiens
  primer_bind 1..21: downstream amplification primer 99-13074 for SEQ 2659, in complement
aatttgctcacacaacaaacc

SEQ ID NO: 10525 - DNA, 19 bp, Homo Sapiens
  primer_bind 1..19: downstream amplification primer 99-13077 for SEQ 2660, in complement
ttcttgcattctgggaggg

SEQ ID NO: 10526 - DNA, 21 bp, Homo Sapiens
  primer_bind 1..21: downstream amplification primer 99-1311 for SEQ 2661, in complement
caaatggaaaatagccaaaac

SEQ ID NO: 10527 - DNA, 19 bp, Homo Sapiens
  primer_bind 1..19: downstream amplification primer 99-13113 for SEQ 2662, in complement
atcagtggttggctgaatc

SEQ ID NO: 10528 - DNA, 18 bp, Homo Sapiens
  primer_bind 1..18: downstream amplification primer 99-13205 for SEQ 2663, in complement
tatggctacagtctgtgg

SEQ ID NO: 10529 - DNA, 19 bp, Homo Sapiens
  primer_bind 1..19: downstream amplification primer 99-1326 for SEQ 2664, in complement
caactgagtctatatcagg

SEQ ID NO: 10530 - DNA, 21 bp, Homo Sapiens
  primer_bind 1..21: downstream amplification primer 99-1333 for SEQ 2665, in complement
gaaataaacagaacactacag

SEQ ID NO: 10531 - DNA, 21 bp, Homo Sapiens
  primer_bind 1..21: downstream amplification primer 99-1335 for SEQ 2666, in complement
gagtgaagtagactagacttg

SEQ ID NO: 10532 - DNA, 21 bp, Homo Sapiens
  primer_bind 1..21: downstream amplification primer 99-13350 for SEQ 2667, in complement
agggctaaagaagaggataac

SEQ ID NO: 10533 - DNA, 18 bp, Homo Sapiens
  primer_bind 1..18: downstream amplification primer 99-13376 for SEQ 2668, in complement
tcttaggaggtggagttg

SEQ ID NO: 10534 - DNA, 21 bp, Homo Sapiens
  primer_bind 1..21: downstream amplification primer 99-13473 for SEQ 2669, in complement
ttaatgctgtatgcctctgtc

SEQ ID NO: 10535 - DNA, 21 bp, Homo Sapiens
  primer_bind 1..21: downstream amplification primer 99-13530 for SEQ 2670, in complement
tcctagtgtgtagacctcatc

SEQ ID NO: 10536 - DNA, 21 bp, Homo Sapiens
  primer_bind 1..21: downstream amplification primer 99-13563 for SEQ 2671, in complement
gttttacttgttttcagcatc

SEQ ID NO: 10537 - DNA, 20 bp, Homo Sapiens
  primer_bind 1..20: downstream amplification primer 99-13579 for SEQ 2672, in complement
aggtacagaaatggtgtagg

SEQ ID NO: 10538 - DNA, 20 bp, Homo Sapiens
  primer_bind 1..20: downstream amplification primer 99-13609 for SEQ 2673, in complement
tcctggggtgagacttgatg

SEQ ID NO: 10539 - DNA, 18 bp, Homo Sapiens
  primer_bind 1..18: downstream amplification primer 99-13621 for SEQ 2674, in complement
tagtgagaggggtgtgag

SEQ ID NO: 10540 - DNA, 20 bp, Homo Sapiens
  primer_bind 1..20: downstream amplification primer 99-1370 for SEQ 2675, in complement
tgttaggtgtgataggtttc

SEQ ID NO: 10541 - DNA, 18 bp, Homo Sapiens
  primer_bind 1..18: downstream amplification primer 99-13864 for SEQ 2676, in complement
cgtgctacagtggtttag

SEQ ID NO: 10542 - DNA, 21 bp, Homo Sapiens
  primer_bind 1..21: downstream amplification primer 99-13938 for SEQ 2677, in complement
tctttccctccttgtctttcc

SEQ ID NO: 10543 - DNA, 20 bp, Homo Sapiens
  primer_bind 1..20: downstream amplification primer 99-13943 for SEQ 2678, in complement
acttcaaaatctgctcatcc

SEQ ID NO: 10544 - DNA, 20 bp, Homo Sapiens
  primer_bind 1..20: downstream amplification primer 99-13948 for SEQ 2679, in complement
gcatttttcagtatgagtgg

SEQ ID NO: 10545 - DNA, 21 bp, Homo Sapiens
  primer_bind 1..21: downstream amplification primer 99-13966 for SEQ 2680, in complement
gccataggatgaagagaaaac

SEQ ID NO: 10546 - DNA, 19 bp, Homo Sapiens
  primer_bind 1..19: downstream amplification primer 99-14002 for SEQ 2681, in complement
cggctctcactgctttctc

SEQ ID NO: 10547 - DNA, 20 bp, Homo Sapiens
  primer_bind 1..20: downstream amplification primer 99-14022 for SEQ 2682, in complement
ctctctaatagggaattggg

SEQ ID NO: 10548 - DNA, 21 bp, Homo Sapiens
  primer_bind 1..21: downstream amplification primer 99-14042 for SEQ 2683, in complement
tgctaattattccaacatctc

SEQ ID NO: 10549 - DNA, 20 bp, Homo Sapiens
  primer_bind 1..20: downstream amplification primer 99-14045 for SEQ 2684, in complement
ctttgttggtgtaaatatgg

SEQ ID NO: 10550 - DNA, 20 bp, Homo Sapiens
  primer_bind 1..20: downstream amplification primer 99-14074 for SEQ 2685, in complement
gcctgaatgatacaaaagtg

SEQ ID NO: 10551 - DNA, 18 bp, Homo Sapiens
  primer_bind 1..18: downstream amplification primer 99-14093 for SEQ 2686, in complement
agagacacacatgctcag

SEQ ID NO: 10552 - DNA, 18 bp, Homo Sapiens
  primer_bind 1..18: downstream amplification primer 99-14105 for SEQ 2687, in complement
ctgtggtctcaccaattc

SEQ ID NO: 10553 - DNA, 18 bp, Homo Sapiens
  primer_bind 1..18: downstream amplification primer 99-14107 for SEQ 2688, in complement
ttagactgagggcattac

SEQ ID NO: 10554 - DNA, 21 bp, Homo Sapiens
  primer_bind 1..21: downstream amplification primer 99-14111 for SEQ 2689, in complement
tatctcagggggaagaaaagg

SEQ ID NO: 10555 - DNA, 21 bp, Homo Sapiens
  primer_bind 1..21: downstream amplification primer 99-14177 for SEQ 2690, in complement
gtgttagcactttgtaagagc

SEQ ID NO: 10556 - DNA, 18 bp, Homo Sapiens
  primer_bind 1..18: downstream amplification primer 99-14198 for SEQ 2691, in complement
aagtgccctgtatagtcc

SEQ ID NO: 10557 - DNA, 21 bp, Homo Sapiens
  primer_bind 1..21: downstream amplification primer 99-14225 for SEQ 2692, in complement
agacaatagattatcatgtgg

SEQ ID NO: 10558 - DNA, 20 bp, Homo Sapiens
  primer_bind 1..20: downstream amplification primer 99-14228 for SEQ 2693, in complement
ccaatttcaaatttcccttc

SEQ ID NO: 10559 - DNA, 21 bp, Homo Sapiens
  primer_bind 1..21: downstream amplification primer 99-14410 for SEQ 2694, in complement
attcactacaaggactcacgg

SEQ ID NO: 10560 - DNA, 21 bp, Homo Sapiens
  primer_bind 1..21: downstream amplification primer 99-14413 for SEQ 2695, in complement
tcctcaatgtagcagtacccc

SEQ ID NO: 10561 - DNA, 20 bp, Homo Sapiens
  primer_bind 1..20: downstream amplification primer 99-14415 for SEQ 2696, in complement
gtcatgtctctccactgctc

SEQ ID NO: 10562 - DNA, 21 bp, Homo Sapiens
  primer_bind 1..21: downstream amplification primer 99-14424 for SEQ 2697, in complement
tttctgaccatgtgactcaac

SEQ ID NO: 10563 - DNA, 19 bp, Homo Sapiens
  primer_bind 1..19: downstream amplification primer 99-14473 for SEQ 2698, in complement
gtttagtgagagaattgtc

SEQ ID NO: 10564 - DNA, 20 bp, Homo Sapiens
  primer_bind 1..20: downstream amplification primer 99-14476 for SEQ 2699, in complement
tggacacaactgaggaggac

SEQ ID NO: 10565 - DNA, 18 bp, Homo Sapiens
  primer_bind 1..18: downstream amplification primer 99-14481 for SEQ 2700, in complement
ccgcatctctgtttttag

SEQ ID NO: 10566 - DNA, 20 bp, Homo Sapiens
  primer_bind 1..20: downstream amplification primer 99-14489 for SEQ 2701, in complement
agtcaacaggtcatatttgg

SEQ ID NO: 10567 - DNA, 21 bp, Homo Sapiens
  primer_bind 1..21: downstream amplification primer 99-14673 for SEQ 2702, in complement
ctgatgggaatatctttaagg

SEQ ID NO: 10568 - DNA, 21 bp, Homo Sapiens
  primer_bind 1..21: downstream amplification primer 99-14705 for SEQ 2703, in complement
ctccttctttcactggctttc

SEQ ID NO: 10569 - DNA, 21 bp, Homo Sapiens
  primer_bind 1..21: downstream amplification primer 99-14739 for SEQ 2704, in complement
aacacatttctaatactccac

SEQ ID NO: 10570 - DNA, 20 bp, Homo Sapiens
  primer_bind 1..20: downstream amplification primer 99-14743 for SEQ 2705, in complement
ctctcgcccatagatagcac

SEQ ID NO: 10571 - DNA, 18 bp, Homo Sapiens
  primer_bind 1..18: downstream amplification primer 99-14944 for SEQ 2706, in complement
atccatgaggggatattg

SEQ ID NO: 10572 - DNA, 21 bp, Homo Sapiens
  primer_bind 1..21: downstream amplification primer 99-14949 for SEQ 2707, in complement
ttaaacatctgcctatttgtc

SEQ ID NO: 10573 - DNA, 18 bp, Homo Sapiens
  primer_bind 1..18: downstream amplification primer 99-15000 for SEQ 2708, in complement
cccctttttactgttacc

SEQ ID NO: 10574 - DNA, 19 bp, Homo Sapiens
  primer_bind 1..19: downstream amplification primer 99-15067 for SEQ 2709, in complement
tgacgagtctcatttaatc

SEQ ID NO: 10575 - DNA, 18 bp, Homo Sapiens
  primer_bind 1..18: downstream amplification primer 99-15192 for SEQ 2710, in complement
gcctggatttgccttttg

SEQ ID NO: 10576 - DNA, 19 bp, Homo Sapiens
  primer_bind 1..19: downstream amplification primer 99-15369 for SEQ 2711, in complement
aagtgactaattcaaggtg

SEQ ID NO: 10577 - DNA, 18 bp, Homo Sapiens
  primer_bind 1..18: downstream amplification primer 99-15423 for SEQ 2712, in complement
atgtctggtggatggatg

SEQ ID NO: 10578 - DNA, 19 bp, Homo Sapiens
  primer_bind 1..19: downstream amplification primer 99-15471 for SEQ 2713, in complement
ttgttgagttttggtgtag

SEQ ID NO: 10579 - DNA, 19 bp, Homo Sapiens
  primer_bind 1..19: downstream amplification primer 99-15538 for SEQ 2714, in complement
agggctgaaactttgctcg

SEQ ID NO: 10580 - DNA, 21 bp, Homo Sapiens
  primer_bind 1..21: downstream amplification primer 99-15588 for SEQ 2715, in complement
atattgagttggtctaacagg

SEQ ID NO: 10581 - DNA, 21 bp, Homo Sapiens
  primer_bind 1..21: downstream amplification primer 99-15615 for SEQ 2716, in complement
ctgtctacaatatgtcttgcc

SEQ ID NO: 10582 - DNA, 19 bp, Homo Sapiens
  primer_bind 1..19: downstream amplification primer 99-15653 for SEQ 2717, in complement
gagatttagtgtagagtcc

SEQ ID NO: 10583 - DNA, 19 bp, Homo Sapiens
  primer_bind 1..19: downstream amplification primer 99-15654 for SEQ 2718, in complement
ggtcaaggatatttaaggg

SEQ ID NO: 10584 - DNA, 21 bp, Homo Sapiens
  primer_bind 1..21: downstream amplification primer 99-15724 for SEQ 2719, in complement
tacataaaatgaccttttggg

SEQ ID NO: 10585 - DNA, 21 bp, Homo Sapiens
  primer_bind 1..21: downstream amplification primer 99-15784 for SEQ 2720, in complement
agatttacttcgcattcttgg

SEQ ID NO: 10586 - DNA, 20 bp, Homo Sapiens
  primer_bind 1..20: downstream amplification primer 99-1591 for SEQ 2721, in complement
tacttcacccatcataagac

SEQ ID NO: 10587 - DNA, 21 bp, Homo Sapiens
  primer_bind 1..21: downstream amplification primer 99-15963 for SEQ 2722, in complement
tccaatcagaatgcttttgac

SEQ ID NO: 10588 - DNA, 19 bp, Homo Sapiens
  primer_bind 1..19: downstream amplification primer 99-15984 for SEQ 2723, in complement
aagggacagagacttcagg

SEQ ID NO: 10589 - DNA, 18 bp, Homo Sapiens
  primer_bind 1..18: downstream amplification primer 99-16017 for SEQ 2724, in complement
gcagagttatgcgttatg

SEQ ID NO: 10590 - DNA, 18 bp, Homo Sapiens
  primer_bind 1..18: downstream amplification primer 99-16026 for SEQ 2725, in complement
gctttccccagatatgac

SEQ ID NO: 10591 - DNA, 20 bp, Homo Sapiens
  primer_bind 1..20: downstream amplification primer 99-1624 for SEQ 2726, in complement
agatgagaaaatttgtcctg

SEQ ID NO: 10592 - DNA, 21 bp, Homo Sapiens
  primer_bind 1..21: downstream amplification primer 99-16241 for SEQ 2727, in complement
attgaataaacttgcttggac

SEQ ID NO: 10593 - DNA, 21 bp, Homo Sapiens
  primer_bind 1..21: downstream amplification primer 99-16259 for SEQ 2728, in complement
cttggctatgctgtttctatg

SEQ ID NO: 10594 - DNA, 20 bp, Homo Sapiens
  primer_bind 1..20: downstream amplification primer 99-16284 for SEQ 2729, in complement
cagataagtggtaaatggtc

SEQ ID NO: 10595 - DNA, 20 bp, Homo Sapiens
  primer_bind 1..20: downstream amplification primer 99-16343 for SEQ 2730, in complement
aaaccccttcgtggtctctc

SEQ ID NO: 10596 - DNA, 21 bp, Homo Sapiens
  primer_bind 1..21: downstream amplification primer 99-16401 for SEQ 2731, in complement
tttgtaattaggtcctgtttg

SEQ ID NO: 10597 - DNA, 20 bp, Homo Sapiens
  primer_bind 1..20: downstream amplification primer 99-16406 for SEQ 2732, in complement
tgctcttctcgttgtgtggg

SEQ ID NO: 10598 - DNA, 20 bp, Homo Sapiens
  primer_bind 1..20: downstream amplification primer 99-16422 for SEQ 2733, in complement
catgctggtctctgttttgg

SEQ ID NO: 10599 - DNA, 20 bp, Homo Sapiens
  primer_bind 1..20: downstream amplification primer 99-16428 for SEQ 2734, in complement
cagaatcatccaatgatacc

SEQ ID NO: 10600 - DNA, 19 bp, Homo Sapiens
  primer_bind 1..19: downstream amplification primer 99-16430 for SEQ 2735, in complement
gcacctccttaaaccatac

SEQ ID NO: 10601 - DNA, 21 bp, Homo Sapiens
  primer_bind 1..21: downstream amplification primer 99-16432 for SEQ 2736, in complement
attgatttggtctctgatttg

SEQ ID NO: 10602 - DNA, 18 bp, Homo Sapiens
  primer_bind 1..18: downstream amplification primer 99-16647 for SEQ 2737, in complement
gactctgtgactcctatg

SEQ ID NO: 10603 - DNA, 19 bp, Homo Sapiens
  primer_bind 1..19: downstream amplification primer 99-16661 for SEQ 2738, in complement
caggagttgtgaacattgg

SEQ ID NO: 10604 - DNA, 21 bp, Homo Sapiens
  primer_bind 1..21: downstream amplification primer 99-16686 for SEQ 2739, in complement
ggaagctggctttagtcttac

SEQ ID NO: 10605 - DNA, 18 bp, Homo Sapiens
  primer_bind 1..18: downstream amplification primer 99-16714 for SEQ 2740, in complement
ccagtaggaagcattcag

SEQ ID NO: 10606 - DNA, 21 bp, Homo Sapiens
  primer_bind 1..21: downstream amplification primer 99-16735 for SEQ 2741, in complement
gttaatccagcttcccaaatc

SEQ ID NO: 10607 - DNA, 21 bp, Homo Sapiens
  primer_bind 1..21: downstream amplification primer 99-16739 for SEQ 2742, in complement
aaaggagctgatgaacatcac

SEQ ID NO: 10608 - DNA, 20 bp, Homo Sapiens
  primer_bind 1..20: downstream amplification primer 99-16751 for SEQ 2743, in complement
aggagacaagacccagagac

SEQ ID NO: 10609 - DNA, 20 bp, Homo Sapiens
  primer_bind 1..20: downstream amplification primer 99-16752 for SEQ 2744, in complement
ctagttatcaacttcccatc

SEQ ID NO: 10610 - DNA, 19 bp, Homo Sapiens
  primer_bind 1..19: downstream amplification primer 99-16754 for SEQ 2745, in complement
aacaccccctttcctttcc

SEQ ID NO: 10611 - DNA, 21 bp, Homo Sapiens
  primer_bind 1..21: downstream amplification primer 99-16758 for SEQ 2746, in complement
gtttttttccatagaatgctc

SEQ ID NO: 10612 - DNA, 21 bp, Homo Sapiens
  primer_bind 1..21: downstream amplification primer 99-16761 for SEQ 2747, in complement
agaacaatgcacttgcatacc

SEQ ID NO: 10613 - DNA, 19 bp, Homo Sapiens
  primer_bind 1..19: downstream amplification primer 99-16769 for SEQ 2748, in complement
catgattcacaaacttgag

SEQ ID NO: 10614 - DNA, 21 bp, Homo Sapiens
  primer_bind 1..21: downstream amplification primer 99-16771 for SEQ 2749, in complement
gaaaactatctctaggggtgg

SEQ ID NO: 10615 - DNA, 18 bp, Homo Sapiens
  primer_bind 1..18: downstream amplification primer 99-16772 for SEQ 2750, in complement
ctagaaggctatcagagg

SEQ ID NO: 10616 - DNA, 20 bp, Homo Sapiens
  primer_bind 1..20: downstream amplification primer 99-16774 for SEQ 2751, in complement
tctctccctgtatctgcgtg

SEQ ID NO: 10617 - DNA, 18 bp, Homo Sapiens
  primer_bind 1..18: downstream amplification primer 99-16776 for SEQ 2752, in complement
aggaacagactcatttgg

SEQ ID NO: 10618 - DNA, 20 bp, Homo Sapiens
  primer_bind 1..20: downstream amplification primer 99-16794 for SEQ 2753, in complement
tagggagcacaataagatac

SEQ ID NO: 10619 - DNA, 21 bp, Homo Sapiens
  primer_bind 1..21: downstream amplification primer 99-16797 for SEQ 2754, in complement
atattccacccaaattcctcc

SEQ ID NO: 10620 - DNA, 20 bp, Homo Sapiens
  primer_bind 1..20: downstream amplification primer 99-16815 for SEQ 2755, in complement
aaatgtgtctgtgaaatctg

SEQ ID NO: 10621 - DNA, 21 bp, Homo Sapiens
  primer_bind 1..21: downstream amplification primer 99-16835 for SEQ 2756, in complement
attcaaagaacaaaaacacgg

SEQ ID NO: 10622 - DNA, 20 bp, Homo Sapiens
  primer_bind 1..20: downstream amplification primer 99-16909 for SEQ 2757, in complement
gcactagataaagttgtttg

SEQ ID NO: 10623 - DNA, 21 bp, Homo Sapiens
  primer_bind 1..21: downstream amplification primer 99-17024 for SEQ 2758, in complement
caaggttttaatgaagaatgc

SEQ ID NO: 10624 - DNA, 18 bp, Homo Sapiens
  primer_bind 1..18: downstream amplification primer 99-17046 for SEQ 2759, in complement
actggtgtaggagcattc

SEQ ID NO: 10625 - DNA, 21 bp, Homo Sapiens
  primer_bind 1..21: downstream amplification primer 99-17075 for SEQ 2760, in complement
gggtaagatggtgatactttg

SEQ ID NO: 10626 - DNA, 19 bp, Homo Sapiens
  primer_bind 1..19: downstream amplification primer 99-17107 for SEQ 2761, in complement
atgagttacttctctaacc

SEQ ID NO: 10627 - DNA, 18 bp, Homo Sapiens
  primer_bind 1..18: downstream amplification primer 99-17162 for SEQ 2762, in complement
atgtagatggactctgtg

SEQ ID NO: 10628 - DNA, 20 bp, Homo Sapiens
  primer_bind 1..20: downstream amplification primer 99-17167 for SEQ 2763, in complement
ctaagactaacgtgtaaatg

SEQ ID NO: 10629 - DNA, 19 bp, Homo Sapiens
  primer_bind 1..19: downstream amplification primer 99-17214 for SEQ 2764, in complement
actgcctattctctatatc

SEQ ID NO: 10630 - DNA, 21 bp, Homo Sapiens
  primer_bind 1..21: downstream amplification primer 99-17254 for SEQ 2765, in complement
tactctcttctactttctccc

SEQ ID NO: 10631 - DNA, 21 bp, Homo Sapiens
  primer_bind 1..21: downstream amplification primer 99-17402 for SEQ 2766, in complement
gaagattgatgtgtaaatggg

SEQ ID NO: 10632 - DNA, 18 bp, Homo Sapiens
  primer_bind 1..18: downstream amplification primer 99-17492 for SEQ 2767, in complement
ccaatttactaacacgcc

SEQ ID NO: 10633 - DNA, 19 bp, Homo Sapiens
  primer_bind 1..19: downstream amplification primer 99-17519 for SEQ 2768, in complement
agaagaaggttccccagtc

SEQ ID NO: 10634 - DNA, 21 bp, Homo Sapiens
  primer_bind 1..21: downstream amplification primer 99-17581 for SEQ 2769, in complement
aatcacctttgtctatactgc

SEQ ID NO: 10635 - DNA, 21 bp, Homo Sapiens
  primer_bind 1..21: downstream amplification primer 99-17716 for SEQ 2770, in complement
agtaggaacagtaagtgaagg

SEQ ID NO: 10636 - DNA, 20 bp, Homo Sapiens
  primer_bind 1..20: downstream amplification primer 99-18122 for SEQ 2771, in complement
gtagtagctttatttctccc

SEQ ID NO: 10637 - DNA, 19 bp, Homo Sapiens
  primer_bind 1..19: downstream amplification primer 99-18126 for SEQ 2772, in complement
ccatcacagacagaaaggg

SEQ ID NO: 10638 - DNA, 18 bp, Homo Sapiens
  primer_bind 1..18: downstream amplification primer 99-18127 for SEQ 2773, in complement
gaagattccatcgtcaag

SEQ ID NO: 10639 - DNA, 21 bp, Homo Sapiens
  primer_bind 1..21: downstream amplification primer 99-18141 for SEQ 2774, in complement
atgtatttcatctcacccttg

SEQ ID NO: 10640 - DNA, 19 bp, Homo Sapiens
  primer_bind 1..19: downstream amplification primer 99-18190 for SEQ 2775, in complement
tagcattgtgcaggtgctc

SEQ ID NO: 10641 - DNA, 19 bp, Homo Sapiens
  primer_bind 1..19: downstream amplification primer 99-18321 for SEQ 2776, in complement
catttgaacagtcttggag

SEQ ID NO: 10642 - DNA, 21 bp, Homo Sapiens
  primer_bind 1..21: downstream amplification primer 99-1833 for SEQ 2777, in complement
atccctttgccaagttctttc

SEQ ID NO: 10643 - DNA, 18 bp, Homo Sapiens
  primer_bind 1..18: downstream amplification primer 99-18334 for SEQ 2778, in complement
ctcagacactggcttttc

SEQ ID NO: 10644 - DNA, 18 bp, Homo Sapiens
  primer_bind 1..18: downstream amplification primer 99-18396 for SEQ 2779, in complement
agcaaaggctttcctttc

SEQ ID NO: 10645 - DNA, 21 bp, Homo Sapiens
  primer_bind 1..21: downstream amplification primer 99-18471 for SEQ 2780, in complement
aggctttttagttcatatctc

SEQ ID NO: 10646 - DNA, 21 bp, Homo Sapiens
  primer_bind 1..21: downstream amplification primer 99-18528 for SEQ 2781, in complement
tgttaggttacatgcttgctg

SEQ ID NO: 10647 - DNA, 18 bp, Homo Sapiens
  primer_bind 1..18: downstream amplification primer 99-18576 for SEQ 2782, in complement
actaacatcacctctcac

SEQ ID NO: 10648 - DNA, 19 bp, Homo Sapiens
  primer_bind 1..19: downstream amplification primer 99-18581 for SEQ 2783, in complement
acacagcattcagacccac

SEQ ID NO: 10649 - DNA, 21 bp, Homo Sapiens
  primer_bind 1..21: downstream amplification primer 99-18645 for SEQ 2784, in complement
cagcaaagtaaacacaccacc

SEQ ID NO: 10650 - DNA, 20 bp, Homo Sapiens
  primer_bind 1..20: downstream amplification primer 99-18696 for SEQ 2785, in complement
ctgggtttttgacatttctg

SEQ ID NO: 10651 - DNA, 21 bp, Homo Sapiens
  primer_bind 1..21: downstream amplification primer 99-18698 for SEQ 2786, in complement
tttcttttcgacaaaaccgcc

SEQ ID NO: 10652 - DNA, 19 bp, Homo Sapiens
  primer_bind 1..19: downstream amplification primer 99-18710 for SEQ 2787, in complement
gcaatcttaacaaaaaggg

SEQ ID NO: 10653 - DNA, 21 bp, Homo Sapiens
  primer_bind 1..21: downstream amplification primer 99-18717 for SEQ 2788, in complement
gcaacagcacactgctattcc

SEQ ID NO: 10654 - DNA, 18 bp, Homo Sapiens
  primer_bind 1..18: downstream amplification primer 99-18718 for SEQ 2789, in complement
taaaaagtcccctccttg

SEQ ID NO: 10655 - DNA, 20 bp, Homo Sapiens
  primer_bind 1..20: downstream amplification primer 99-18771 for SEQ 2790, in complement
cacccccaggcttataaatg

SEQ ID NO: 10656 - DNA, 18 bp, Homo Sapiens
  primer_bind 1..18: downstream amplification primer 99-1879 for SEQ 2791, in complement
aatttgccctggtttctg

SEQ ID NO: 10657 - DNA, 21 bp, Homo Sapiens
  primer_bind 1..21: downstream amplification primer 99-18886 for SEQ 2792, in complement
caactcattctcaaagaaatc

SEQ ID NO: 10658 - DNA, 18 bp, Homo Sapiens
  primer_bind 1..18: downstream amplification primer 99-18944 for SEQ 2793, in complement
gatttttacccaccagag

SEQ ID NO: 10659 - DNA, 18 bp, Homo Sapiens
  primer_bind 1..18: downstream amplification primer 99-19023 for SEQ 2794, in complement
ttggacacttggactcac

SEQ ID NO: 10660 - DNA, 19 bp, Homo Sapiens
  primer_bind 1..19: downstream amplification primer 99-19027 for SEQ 2795, in complement
aggaggtgagttgtaggag

SEQ ID NO: 10661 - DNA, 20 bp, Homo Sapiens
  primer_bind 1..20: downstream amplification primer 99-19033 for SEQ 2796, in complement
gtgcaggtactgttattatc

SEQ ID NO: 10662 - DNA, 21 bp, Homo Sapiens
  primer_bind 1..21: downstream amplification primer 99-19040 for SEQ 2797, in complement
acaaagagaactgggtctgtc

SEQ ID NO: 10663 - DNA, 21 bp, Homo Sapiens
  primer_bind 1..21: downstream amplification primer 99-19041 for SEQ 2798, in complement
tttggggttccttcctaagac

SEQ ID NO: 10664 - DNA, 20 bp, Homo Sapiens
  primer_bind 1..20: downstream amplification primer 99-19048 for SEQ 2799, in complement
agtcacagttgatataatgg

SEQ ID NO: 10665 - DNA, 21 bp, Homo Sapiens
  primer_bind 1..21: downstream amplification primer 99-19050 for SEQ 2800, in complement
gactctcatcagaagaaaaac

SEQ ID NO: 10666 - DNA, 21 bp, Homo Sapiens
  primer_bind 1..21: downstream amplification primer 99-19053 for SEQ 2801, in complement
atcctagtggtgagtcctctg

SEQ ID NO: 10667 - DNA, 21 bp, Homo Sapiens
  primer_bind 1..21: downstream amplification primer 99-19055 for SEQ 2802, in complement
acagttccccgattttacccc

SEQ ID NO: 10668 - DNA, 20 bp, Homo Sapiens
  primer_bind 1..20: downstream amplification primer 99-19059 for SEQ 2803, in complement
gccaaaagctaccttactgc

SEQ ID NO: 10669 - DNA, 20 bp, Homo Sapiens
  primer_bind 1..20: downstream amplification primer 99-19069 for SEQ 2804, in complement
cggtgagactgatttttttc

SEQ ID NO: 10670 - DNA, 21 bp, Homo Sapiens
  primer_bind 1..21: downstream amplification primer 99-19095 for SEQ 2805, in complement
agtcagatggctgctgaaatc

SEQ ID NO: 10671 - DNA, 21 bp, Homo Sapiens
  primer_bind 1..21: downstream amplification primer 99-19096 for SEQ 2806, in complement
caagtgtaagactgcgtttgg

SEQ ID NO: 10672 - DNA, 21 bp, Homo Sapiens
  primer_bind 1..21: downstream amplification primer 99-19104 for SEQ 2807, in complement
tcccatatttctttccagccc

SEQ ID NO: 10673 - DNA, 21 bp, Homo Sapiens
  primer_bind 1..21: downstream amplification primer 99-19105 for SEQ 2808, in complement
aaatcagccaagcataccgac

SEQ ID NO: 10674 - DNA, 21 bp, Homo Sapiens
  primer_bind 1..21: downstream amplification primer 99-19108 for SEQ 2809, in complement
tttagggaggtgaggatgtag

SEQ ID NO: 10675 - DNA, 21 bp, Homo Sapiens
  primer_bind 1..21: downstream amplification primer 99-19110 for SEQ 2810, in complement
atgaaggaatccacccacgag

SEQ ID NO: 10676 - DNA, 21 bp, Homo Sapiens
  primer_bind 1..21: downstream amplification primer 99-19122 for SEQ 2811, in complement
aaatcaagaacgagtgtgagg

SEQ ID NO: 10677 - DNA, 21 bp, Homo Sapiens
  primer_bind 1..21: downstream amplification primer 99-19123 for SEQ 2812, in complement
cctttgtctcataaatttgcc

SEQ ID NO: 10678 - DNA, 19 bp, Homo Sapiens
  primer_bind 1..19: downstream amplification primer 99-19130 for SEQ 2813, in complement
agcattcaacgaaagtatc

SEQ ID NO: 10679 - DNA, 21 bp, Homo Sapiens
  primer_bind 1..21: downstream amplification primer 99-19137 for SEQ 2814, in complement
acccagtgagccaatgatgag

SEQ ID NO: 10680 - DNA, 21 bp, Homo Sapiens
  primer_bind 1..21: downstream amplification primer 99-19142 for SEQ 2815, in complement
ccttcttgagaaactccacac

SEQ ID NO: 10681 - DNA, 21 bp, Homo Sapiens
  primer_bind 1..21: downstream amplification primer 99-19154 for SEQ 2816, in complement
ttttccatgacccagtgagcc

SEQ ID NO: 10682 - DNA, 21 bp, Homo Sapiens
  primer_bind 1..21: downstream amplification primer 99-19155 for SEQ 2817, in complement
ctaatgactccctcctctctg

SEQ ID NO: 10683 - DNA, 19 bp, Homo Sapiens
  primer_bind 1..19: downstream amplification primer 99-19167 for SEQ 2818, in complement
tcaaagggacctagcagac

SEQ ID NO: 10684 - DNA, 21 bp, Homo Sapiens
  primer_bind 1..21: downstream amplification primer 99-19170 for SEQ 2819, in complement
ctgcaaacaagtcacacaatg

SEQ ID NO: 10685 - DNA, 20 bp, Homo Sapiens
  primer_bind 1..20: downstream amplification primer 99-19171 for SEQ 2820, in complement
agagagtggacatcatcccc

SEQ ID NO: 10686 - DNA, 19 bp, Homo Sapiens
  primer_bind 1..19: downstream amplification primer 99-19175 for SEQ 2821, in complement
atccgtcactttagccagg

SEQ ID NO: 10687 - DNA, 21 bp, Homo Sapiens
  primer_bind 1..21: downstream amplification primer 99-19177 for SEQ 2822, in complement
ggctctcaagaagatattggg

SEQ ID NO: 10688 - DNA, 21 bp, Homo Sapiens
  primer_bind 1..21: downstream amplification primer 99-19178 for SEQ 2823, in complement
ctggctctcatgtgtattctc

SEQ ID NO: 10689 - DNA, 19 bp, Homo Sapiens
  primer_bind 1..19: downstream amplification primer 99-19210 for SEQ 2824, in complement
gacagtgttcacacagaag

SEQ ID NO: 10690 - DNA, 20 bp, Homo Sapiens
  primer_bind 1..20: downstream amplification primer 99-19219 for SEQ 2825, in complement
aatacaggcacaccagggac

SEQ ID NO: 10691 - DNA, 21 bp, Homo Sapiens
  primer_bind 1..21: downstream amplification primer 99-19220 for SEQ 2826, in complement
ggcttcaatagatgtggcaag

SEQ ID NO: 10692 - DNA, 20 bp, Homo Sapiens
  primer_bind 1..20: downstream amplification primer 99-19223 for SEQ 2827, in complement
agtggggtattgggagcatc

SEQ ID NO: 10693 - DNA, 21 bp, Homo Sapiens
  primer_bind 1..21: downstream amplification primer 99-19226 for SEQ 2828, in complement
ttctcattgcatcctcattcc

SEQ ID NO: 10694 - DNA, 21 bp, Homo Sapiens
  primer_bind 1..21: downstream amplification primer 99-19228 for SEQ 2829, in complement
atggtgctctgtcttcctctc

SEQ ID NO: 10695 - DNA, 21 bp, Homo Sapiens
  primer_bind 1..21: downstream amplification primer 99-19236 for SEQ 2830, in complement
ccttaaactgacctccagtcc

SEQ ID NO: 10696 - DNA, 21 bp, Homo Sapiens
  primer_bind 1..21: downstream amplification primer 99-19241 for SEQ 2831, in complement
aatggtctcacgcctcatttc

SEQ ID NO: 10697 - DNA, 20 bp, Homo Sapiens
  primer_bind 1..20: downstream amplification primer 99-19242 for SEQ 2832, in complement
aggtggatggttcctagctg

SEQ ID NO: 10698 - DNA, 19 bp, Homo Sapiens
  primer_bind 1..19: downstream amplification primer 99-19283 for SEQ 2833, in complement
cagcagttctcttaggtgg

SEQ ID NO: 10699 - DNA, 21 bp, Homo Sapiens
  primer_bind 1..21: downstream amplification primer 99-19295 for SEQ 2834, in complement
gtgtaagcagcatgtgaagcc

SEQ ID NO: 10700 - DNA, 20 bp, Homo Sapiens
  primer_bind 1..20: downstream amplification primer 99-19304 for SEQ 2835, in complement
taagacatcgcagttgttac

SEQ ID NO: 10701 - DNA, 21 bp, Homo Sapiens
  primer_bind 1..21: downstream amplification primer 99-19305 for SEQ 2836, in complement
aattccacaaggttcaggctc

SEQ ID NO: 10702 - DNA, 20 bp, Homo Sapiens
  primer_bind 1..20: downstream amplification primer 99-19309 for SEQ 2837, in complement
agaaacaacattgccatctg

SEQ ID NO: 10703 - DNA, 20 bp, Homo Sapiens
  primer_bind 1..20: downstream amplification primer 99-19312 for SEQ 2838, in complement
gtgtaataactgctcttttc

SEQ ID NO: 10704 - DNA, 18 bp, Homo Sapiens
  primer_bind 1..18: downstream amplification primer 99-19324 for SEQ 2839, in complement
catagtattcttgcaggg

SEQ ID NO: 10705 - DNA, 20 bp, Homo Sapiens
  primer_bind 1..20: downstream amplification primer 99-19330 for SEQ 2840, in complement
gaagtagagggttagatttg

SEQ ID NO: 10706 - DNA, 20 bp, Homo Sapiens
  primer_bind 1..20: downstream amplification primer 99-19347 for SEQ 2841, in complement
cacttatacgaataggaagg

SEQ ID NO: 10707 - DNA, 21 bp, Homo Sapiens
  primer_bind 1..21: downstream amplification primer 99-19348 for SEQ 2842, in complement
caatcactgctctgtaagaag

SEQ ID NO: 10708 - DNA, 21 bp, Homo Sapiens
  primer_bind 1..21: downstream amplification primer 99-19351 for SEQ 2843, in complement
catttctctcctctcatcctg

SEQ ID NO: 10709 - DNA, 21 bp, Homo Sapiens
  primer_bind 1..21: downstream amplification primer 99-19368 for SEQ 2844, in complement
aatctgctcctattaacatcc

SEQ ID NO: 10710 - DNA, 21 bp, Homo Sapiens
  primer_bind 1..21: downstream amplification primer 99-19375 for SEQ 2845, in complement
ggagacaatatgttataccag

SEQ ID NO: 10711 - DNA, 21 bp, Homo Sapiens
  primer_bind 1..21: downstream amplification primer 99-19381 for SEQ 2846, in complement
atcattccttgaaatctaccc

SEQ ID NO: 10712 - DNA, 21 bp, Homo Sapiens
  primer_bind 1..21: downstream amplification primer 99-19383 for SEQ 2847, in complement
tggcttctatatgctactgag

SEQ ID NO: 10713 - DNA, 21 bp, Homo Sapiens
  primer_bind 1..21: downstream amplification primer 99-19384 for SEQ 2848, in complement
tacactgaatgcttgctgctc

SEQ ID NO: 10714 - DNA, 21 bp, Homo Sapiens
  primer_bind 1..21: downstream amplification primer 99-19418 for SEQ 2849, in complement
tcttaaaagtggtgagtacag

SEQ ID NO: 10715 - DNA, 21 bp, Homo Sapiens
  primer_bind 1..21: downstream amplification primer 99-19420 for SEQ 2850, in complement
atgacatttgaaaggagacgg

SEQ ID NO: 10716 - DNA, 19 bp, Homo Sapiens
  primer_bind 1..19: downstream amplification primer 99-19426 for SEQ 2851, in complement
accattcaagaggtccagc

SEQ ID NO: 10717 - DNA, 21 bp, Homo Sapiens
  primer_bind 1..21: downstream amplification primer 99-19431 for SEQ 2852, in complement
agagctaaagactctatccag

SEQ ID NO: 10718 - DNA, 21 bp, Homo Sapiens
  primer_bind 1..21: downstream amplification primer 99-19438 for SEQ 2853, in complement
tacttggttctgattgctgtg

SEQ ID NO: 10719 - DNA, 21 bp, Homo Sapiens
  primer_bind 1..21: downstream amplification primer 99-19442 for SEQ 2854, in complement
agtatgtaagccagaaagggg

SEQ ID NO: 10720 - DNA, 21 bp, Homo Sapiens
  primer_bind 1..21: downstream amplification primer 99-19444 for SEQ 2855, in complement
ataatccacagtatagccttc

SEQ ID NO: 10721 - DNA, 18 bp, Homo Sapiens
  primer_bind 1..18: downstream amplification primer 99-19450 for SEQ 2856, in complement
aggaattacgaacggtgg

SEQ ID NO: 10722 - DNA, 21 bp, Homo Sapiens
  primer_bind 1..21: downstream amplification primer 99-19453 for SEQ 2857, in complement
cctcaaattcccaatcaacac

SEQ ID NO: 10723 - DNA, 21 bp, Homo Sapiens
  primer_bind 1..21: downstream amplification primer 99-19457 for SEQ 2858, in complement
ggatttgtgatgaaacagcag

SEQ ID NO: 10724 - DNA, 21 bp, Homo Sapiens
  primer_bind 1..21: downstream amplification primer 99-19460 for SEQ 2859, in complement
gttaaatgcaatcgtgtgacc

SEQ ID NO: 10725 - DNA, 21 bp, Homo Sapiens
  primer_bind 1..21: downstream amplification primer 99-19461 for SEQ 2860, in complement
tccaacaaagcaaaacttgac

SEQ ID NO: 10726 - DNA, 21 bp, Homo Sapiens
  primer_bind 1..21: downstream amplification primer 99-19464 for SEQ 2861, in complement
gaaatcttatgaggagtggag

SEQ ID NO: 10727 - DNA, 20 bp, Homo Sapiens
  primer_bind 1..20: downstream amplification primer 99-19466 for SEQ 2862, in complement
agtaaagataagacagacac

SEQ ID NO: 10728 - DNA, 21 bp, Homo Sapiens
  primer_bind 1..21: downstream amplification primer 99-19474 for SEQ 2863, in complement
ttccctccagtgtagattccc

SEQ ID NO: 10729 - DNA, 21 bp, Homo Sapiens
  primer_bind 1..21: downstream amplification primer 99-19475 for SEQ 2864, in complement
gcttatctgccttcttctctc

SEQ ID NO: 10730 - DNA, 21 bp, Homo Sapiens
  primer_bind 1..21: downstream amplification primer 99-19477 for SEQ 2865, in complement
tacttttttccccttgctccg

SEQ ID NO: 10731 - DNA, 21 bp, Homo Sapiens
  primer_bind 1..21: downstream amplification primer 99-19504 for SEQ 2866, in complement
atgaggaagaatttagggtgg

SEQ ID NO: 10732 - DNA, 21 bp, Homo Sapiens
  primer_bind 1..21: downstream amplification primer 99-19528 for SEQ 2867, in complement
gactggtgaattgcatttctg

SEQ ID NO: 10733 - DNA, 19 bp, Homo Sapiens
  primer_bind 1..19: downstream amplification primer 99-19529 for SEQ 2868, in complement
ccaggtaaatcccaagcag

SEQ ID NO: 10734 - DNA, 21 bp, Homo Sapiens
  primer_bind 1..21: downstream amplification primer 99-19532 for SEQ 2869, in complement
ataaacacaggaagagaggag

SEQ ID NO: 10735 - DNA, 21 bp, Homo Sapiens
  primer_bind 1..21: downstream amplification primer 99-19538 for SEQ 2870, in complement
atgtggctttctaatacattg

SEQ ID NO: 10736 - DNA, 21 bp, Homo Sapiens
  primer_bind 1..21: downstream amplification primer 99-19544 for SEQ 2871, in complement
catatcttaaatatgggcagg

SEQ ID NO: 10737 - DNA, 21 bp, Homo Sapiens
  primer_bind 1..21: downstream amplification primer 99-19546 for SEQ 2872, in complement
agtatctttcatcatcctctg

SEQ ID NO: 10738 - DNA, 21 bp, Homo Sapiens
  primer_bind 1..21: downstream amplification primer 99-19550 for SEQ 2873, in complement
taccaccgaacagaaccacac

SEQ ID NO: 10739 - DNA, 21 bp, Homo Sapiens
  primer_bind 1..21: downstream amplification primer 99-19553 for SEQ 2874, in complement
acataaatggtgttatccctg

SEQ ID NO: 10740 - DNA, 21 bp, Homo Sapiens
  primer_bind 1..21: downstream amplification primer 99-19557 for SEQ 2875, in complement
ccttggtgaaacatcaaactc

SEQ ID NO: 10741 - DNA, 21 bp, Homo Sapiens
  primer_bind 1..21: downstream amplification primer 99-19560 for SEQ 2876, in complement
cccaaataaaatgtagttctc

SEQ ID NO: 10742 - DNA, 21 bp, Homo Sapiens
  primer_bind 1..21: downstream amplification primer 99-19562 for SEQ 2877, in complement
ggtttcttcatgcaaacattc

SEQ ID NO: 10743 - DNA, 21 bp, Homo Sapiens
  primer_bind 1..21: downstream amplification primer 99-19566 for SEQ 2878, in complement
gcttgcccaaagtgattctcc

SEQ ID NO: 10744 - DNA, 21 bp, Homo Sapiens
  primer_bind 1..21: downstream amplification primer 99-19568 for SEQ 2879, in complement
ttctgcttgtctttccactgc

SEQ ID NO: 10745 - DNA, 20 bp, Homo Sapiens
  primer_bind 1..20: downstream amplification primer 99-19575 for SEQ 2880, in complement
tctcctgtaagctccttatg

SEQ ID NO: 10746 - DNA, 20 bp, Homo Sapiens
  primer_bind 1..20: downstream amplification primer 99-19578 for SEQ 2881, in complement
tgaggattaggttgtttcag

SEQ ID NO: 10747 - DNA, 19 bp, Homo Sapiens
  primer_bind 1..19: downstream amplification primer 99-19580 for SEQ 2882, in complement
cgtaggtataaaaagaagg

SEQ ID NO: 10748 - DNA, 19 bp, Homo Sapiens
  primer_bind 1..19: downstream amplification primer 99-19584 for SEQ 2883, in complement
tggatggggttacagtagg

SEQ ID NO: 10749 - DNA, 21 bp, Homo Sapiens
  primer_bind 1..21: downstream amplification primer 99-19588 for SEQ 2884, in complement
tgtctgagcaaatgtaaaatg

SEQ ID NO: 10750 - DNA, 21 bp, Homo Sapiens
  primer_bind 1..21: downstream amplification primer 99-19589 for SEQ 2885, in complement
tcagtcaatatcttcacacag

SEQ ID NO: 10751 - DNA, 21 bp, Homo Sapiens
  primer_bind 1..21: downstream amplification primer 99-19601 for SEQ 2886, in complement
ccttcatctttccttttatac

SEQ ID NO: 10752 - DNA, 21 bp, Homo Sapiens
  primer_bind 1..21: downstream amplification primer 99-19624 for SEQ 2887, in complement
ccaactttacatagcctctac

SEQ ID NO: 10753 - DNA, 21 bp, Homo Sapiens
  primer_bind 1..21: downstream amplification primer 99-19634 for SEQ 2888, in complement
ttagtcattgatgcaaaagcc

SEQ ID NO: 10754 - DNA, 21 bp, Homo Sapiens
  primer_bind 1..21: downstream amplification primer 99-19639 for SEQ 2889, in complement
cactgaggtcagaatgaatag

SEQ ID NO: 10755 - DNA, 20 bp, Homo Sapiens
  primer_bind 1..20: downstream amplification primer 99-19645 for SEQ 2890, in complement
aagtaaccacaaggcggcag

SEQ ID NO: 10756 - DNA, 21 bp, Homo Sapiens
  primer_bind 1..21: downstream amplification primer 99-19650 for SEQ 2891, in complement
acattccttagcaaataccac

SEQ ID NO: 10757 - DNA, 21 bp, Homo Sapiens
  primer_bind 1..21: downstream amplification primer 99-19651 for SEQ 2892, in complement
ctgagattgtcttctggcttc

SEQ ID NO: 10758 - DNA, 21 bp, Homo Sapiens
  primer_bind 1..21: downstream amplification primer 99-19664 for SEQ 2893, in complement
ctaaatgggctcttcaacatc

SEQ ID NO: 10759 - DNA, 19 bp, Homo Sapiens
  primer_bind 1..19: downstream amplification primer 99-19673 for SEQ 2894, in complement
atgtattacacccttcagc

SEQ ID NO: 10760 - DNA, 19 bp, Homo Sapiens
  primer_bind 1..19: downstream amplification primer 99-19678 for SEQ 2895, in complement
gtgagggtgtgatgtattg

SEQ ID NO: 10761 - DNA, 20 bp, Homo Sapiens
  primer_bind 1..20: downstream amplification primer 99-19685 for SEQ 2896, in complement
tcgctgtaaccatctgctcc

SEQ ID NO: 10762 - DNA, 21 bp, Homo Sapiens
  primer_bind 1..21: downstream amplification primer 99-19697 for SEQ 2897, in complement
ttgtgctcatttttctaagtc

SEQ ID NO: 10763 - DNA, 20 bp, Homo Sapiens
  primer_bind 1..20: downstream amplification primer 99-19703 for SEQ 2898, in complement
cacaaagactgttctgttac

SEQ ID NO: 10764 - DNA, 21 bp, Homo Sapiens
  primer_bind 1..21: downstream amplification primer 99-19705 for SEQ 2899, in complement
ataggaaaaaaatttgggggg

SEQ ID NO: 10765 - DNA, 20 bp, Homo Sapiens
  primer_bind 1..20: downstream amplification primer 99-19709 for SEQ 2900, in complement
tatataacccacaccctctc

SEQ ID NO: 10766 - DNA, 20 bp, Homo Sapiens
  primer_bind 1..20: downstream amplification primer 99-19711 for SEQ 2901, in complement
ccgattggctgaaggaactg

SEQ ID NO: 10767 - DNA, 21 bp, Homo Sapiens
  primer_bind 1..21: downstream amplification primer 99-19722 for SEQ 2902, in complement
tcacactccaatccactcatc

SEQ ID NO: 10768 - DNA, 21 bp, Homo Sapiens
  primer_bind 1..21: downstream amplification primer 99-19731 for SEQ 2903, in complement
ttggaagacatctctccgaac

SEQ ID NO: 10769 - DNA, 21 bp, Homo Sapiens
  primer_bind 1..21: downstream amplification primer 99-19732 for SEQ 2904, in complement
tatctggacaaaccattgggc

SEQ ID NO: 10770 - DNA, 21 bp, Homo Sapiens
  primer_bind 1..21: downstream amplification primer 99-19736 for SEQ 2905, in complement
tttcttgctgcttggaaatgg

SEQ ID NO: 10771 - DNA, 21 bp, Homo Sapiens
  primer_bind 1..21: downstream amplification primer 99-19745 for SEQ 2906, in complement
ctttctattccctcgttgctc

SEQ ID NO: 10772 - DNA, 21 bp, Homo Sapiens
  primer_bind 1..21: downstream amplification primer 99-19749 for SEQ 2907, in complement
tttggtaagtcaatgacgagg

SEQ ID NO: 10773 - DNA, 20 bp, Homo Sapiens
  primer_bind 1..20: downstream amplification primer 99-19752 for SEQ 2908, in complement
agacccaagtgaagacggag

SEQ ID NO: 10774 - DNA, 21 bp, Homo Sapiens
  primer_bind 1..21: downstream amplification primer 99-19753 for SEQ 2909, in complement
cattggtggattaaaggggag

SEQ ID NO: 10775 - DNA, 20 bp, Homo Sapiens
  primer_bind 1..20: downstream amplification primer 99-19756 for SEQ 2910, in complement
ggaaaagtcgcttccctcac

SEQ ID NO: 10776 - DNA, 21 bp, Homo Sapiens
  primer_bind 1..21: downstream amplification primer 99-19764 for SEQ 2911, in complement
tttcagaatcagggaaatcac

SEQ ID NO: 10777 - DNA, 19 bp, Homo Sapiens
  primer_bind 1..19: downstream amplification primer 99-19769 for SEQ 2912, in complement
taacatcgtgagttcttag

SEQ ID NO: 10778 - DNA, 20 bp, Homo Sapiens
  primer_bind 1..20: downstream amplification primer 99-19780 for SEQ 2913, in complement
caacaatctctccagcagcc

SEQ ID NO: 10779 - DNA, 21 bp, Homo Sapiens
  primer_bind 1..21: downstream amplification primer 99-19785 for SEQ 2914, in complement
tgagcagaaaaaacatgggac

SEQ ID NO: 10780 - DNA, 21 bp, Homo Sapiens
  primer_bind 1..21: downstream amplification primer 99-19790 for SEQ 2915, in complement
ccacaacattaaatgggacac

SEQ ID NO: 10781 - DNA, 20 bp, Homo Sapiens
  primer_bind 1..20: downstream amplification primer 99-19791 for SEQ 2916, in complement
gtatgacagtaataggtaag

SEQ ID NO: 10782 - DNA, 21 bp, Homo Sapiens
  primer_bind 1..21: downstream amplification primer 99-19795 for SEQ 2917, in complement
aagaatttcacaagaagtcag

SEQ ID NO: 10783 - DNA, 21 bp, Homo Sapiens
  primer_bind 1..21: downstream amplification primer 99-19796 for SEQ 2918, in complement
tgctttagtgtccctaaaccc

SEQ ID NO: 10784 - DNA, 21 bp, Homo Sapiens
  primer_bind 1..21: downstream amplification primer 99-19807 for SEQ 2919, in complement
gtacaaatttcaagtcccacc

SEQ ID NO: 10785 - DNA, 21 bp, Homo Sapiens
  primer_bind 1..21: downstream amplification primer 99-19813 for SEQ 2920, in complement
agtgctgctgagtttgtagag

SEQ ID NO: 10786 - DNA, 21 bp, Homo Sapiens
  primer_bind 1..21: downstream amplification primer 99-19818 for SEQ 2921, in complement
gccacattttagactgtgaag

SEQ ID NO: 10787 - DNA, 21 bp, Homo Sapiens
  primer_bind 1..21: downstream amplification primer 99-19826 for SEQ 2922, in complement
catgataccaaggtgaataac

SEQ ID NO: 10788 - DNA, 21 bp, Homo Sapiens
  primer_bind 1..21: downstream amplification primer 99-19839 for SEQ 2923, in complement
gaggtagggaatgaagaatgg

SEQ ID NO: 10789 - DNA, 21 bp, Homo Sapiens
  primer_bind 1..21: downstream amplification primer 99-19851 for SEQ 2924, in complement
tttgaacctctggaaaccctg

SEQ ID NO: 10790 - DNA, 21 bp, Homo Sapiens
  primer_bind 1..21: downstream amplification primer 99-19858 for SEQ 2925, in complement
tcttccccttacccaaataac

SEQ ID NO: 10791 - DNA, 21 bp, Homo Sapiens
  primer_bind 1..21: downstream amplification primer 99-19860 for SEQ 2926, in complement
aagagaaaagagtgattcccc

SEQ ID NO: 10792 - DNA, 21 bp, Homo Sapiens
  primer_bind 1..21: downstream amplification primer 99-19864 for SEQ 2927, in complement
tattaactgtgcctgtgtctc

SEQ ID NO: 10793 - DNA, 21 bp, Homo Sapiens
  primer_bind 1..21: downstream amplification primer 99-19871 for SEQ 2928, in complement
ttactgtttgtctcctcacac

SEQ ID NO: 10794 - DNA, 21 bp, Homo Sapiens
  primer_bind 1..21: downstream amplification primer 99-19872 for SEQ 2929, in complement
tccaaacattccagagttgag

SEQ ID NO: 10795 - DNA, 20 bp, Homo Sapiens
  primer_bind 1..20: downstream amplification primer 99-19875 for SEQ 2930, in complement
acctttttagtctcttttcc

SEQ ID NO: 10796 - DNA, 21 bp, Homo Sapiens
  primer_bind 1..21: downstream amplification primer 99-19876 for SEQ 2931, in complement
atgggagagggaagaaagttg

SEQ ID NO: 10797 - DNA, 20 bp, Homo Sapiens
  primer_bind 1..20: downstream amplification primer 99-19890 for SEQ 2932, in complement
gaaaaatacgagagtaatgc

SEQ ID NO: 10798 - DNA, 21 bp, Homo Sapiens
  primer_bind 1..21: downstream amplification primer 99-19896 for SEQ 2933, in complement
caatggttagatggacagagg

SEQ ID NO: 10799 - DNA, 21 bp, Homo Sapiens
  primer_bind 1..21: downstream amplification primer 99-19901 for SEQ 2934, in complement
caggatgttccaagctctgtg

SEQ ID NO: 10800 - DNA, 21 bp, Homo Sapiens
  primer_bind 1..21: downstream amplification primer 99-19906 for SEQ 2935, in complement
tcagtgaaccaattagaacag

SEQ ID NO: 10801 - DNA, 21 bp, Homo Sapiens
  primer_bind 1..21: downstream amplification primer 99-19911 for SEQ 2936, in complement
ggagattggattaagaatttg

SEQ ID NO: 10802 - DNA, 21 bp, Homo Sapiens
  primer_bind 1..21: downstream amplification primer 99-19916 for SEQ 2937, in complement
gatctaatgaaacactaagcc

SEQ ID NO: 10803 - DNA, 20 bp, Homo Sapiens
  primer_bind 1..20: downstream amplification primer 99-19922 for SEQ 2938, in complement
agtcccacttgctctgatgc

SEQ ID NO: 10804 - DNA, 21 bp, Homo Sapiens
  primer_bind 1..21: downstream amplification primer 99-19923 for SEQ 2939, in complement
tgtaaatcacctgtcttgttc

SEQ ID NO: 10805 - DNA, 21 bp, Homo Sapiens
  primer_bind 1..21: downstream amplification primer 99-19933 for SEQ 2940, in complement
gtcatccaggaagactccaac

SEQ ID NO: 10806 - DNA, 21 bp, Homo Sapiens
  primer_bind 1..21: downstream amplification primer 99-19937 for SEQ 2941, in complement
atcagtgctttgaatcccccc

SEQ ID NO: 10807 - DNA, 20 bp, Homo Sapiens
  primer_bind 1..20: downstream amplification primer 99-19944 for SEQ 2942, in complement
gcatcaacttcctatgccag

SEQ ID NO: 10808 - DNA, 21 bp, Homo Sapiens
  primer_bind 1..21: downstream amplification primer 99-19951 for SEQ 2943, in complement
cgtaatggactatctacatgg

SEQ ID NO: 10809 - DNA, 21 bp, Homo Sapiens
  primer_bind 1..21: downstream amplification primer 99-20038 for SEQ 2944, in complement
accgaaaacagtcaactctcc

SEQ ID NO: 10810 - DNA, 20 bp, Homo Sapiens
  primer_bind 1..20: downstream amplification primer 99-20072 for SEQ 2945, in complement
agtctatggctcttaaaatg

SEQ ID NO: 10811 - DNA, 18 bp, Homo Sapiens
  primer_bind 1..18: downstream amplification primer 99-20226 for SEQ 2946, in complement
tcgacccagcatatttag

SEQ ID NO: 10812 - DNA, 19 bp, Homo Sapiens
  primer_bind 1..19: downstream amplification primer 99-20228 for SEQ 2947, in complement
ttaaacgaacacattcctg

SEQ ID NO: 10813 - DNA, 18 bp, Homo Sapiens
  primer_bind 1..18: downstream amplification primer 99-20234 for SEQ 2948, in complement
tcaataccctgagacacc

SEQ ID NO: 10814 - DNA, 21 bp, Homo Sapiens
  primer_bind 1..21: downstream amplification primer 99-20537 for SEQ 2949, in complement
tgttcctatcagtatcagttg

SEQ ID NO: 10815 - DNA, 18 bp, Homo Sapiens
  primer_bind 1..18: downstream amplification primer 99-20733 for SEQ 2950, in complement
ggcagcactaatgttttc

SEQ ID NO: 10816 - DNA, 19 bp, Homo Sapiens
  primer_bind 1..19: downstream amplification primer 99-20815 for SEQ 2951, in complement
aatccatcaagttcagttc

SEQ ID NO: 10817 - DNA, 21 bp, Homo Sapiens
  primer_bind 1..21: downstream amplification primer 99-20896 for SEQ 2952, in complement
attgaacaatgccttttcccc

SEQ ID NO: 10818 - DNA, 18 bp, Homo Sapiens
  primer_bind 1..18: downstream amplification primer 99-20958 for SEQ 2953, in complement
atttctccttccccctac

SEQ ID NO: 10819 - DNA, 19 bp, Homo Sapiens
  primer_bind 1..19: downstream amplification primer 99-21057 for SEQ 2954, in complement
tgagagaacagaacactac

SEQ ID NO: 10820 - DNA, 21 bp, Homo Sapiens
  primer_bind 1..21: downstream amplification primer 99-21059 for SEQ 2955, in complement
cagtctgtcagcttcacagtc

SEQ ID NO: 10821 - DNA, 21 bp, Homo Sapiens
  primer_bind 1..21: downstream amplification primer 99-21110 for SEQ 2956, in complement
gtatatcgtgaacttaaaagg

SEQ ID NO: 10822 - DNA, 18 bp, Homo Sapiens
  primer_bind 1..18: downstream amplification primer 99-21123 for SEQ 2957, in complement
ggttgctgggactatatg

SEQ ID NO: 10823 - DNA, 21 bp, Homo Sapiens
  primer_bind 1..21: downstream amplification primer 99-21133 for SEQ 2958, in complement
aagaactgtatcttccaagcc

SEQ ID NO: 10824 - DNA, 21 bp, Homo Sapiens
  primer_bind 1..21: downstream amplification primer 99-21181 for SEQ 2959, in complement
agaatgaggtgaacgtaaagg

SEQ ID NO: 10825 - DNA, 20 bp, Homo Sapiens
  primer_bind 1..20: downstream amplification primer 99-21192 for SEQ 2960, in complement
atctctgcccaactgctgac

SEQ ID NO: 10826 - DNA, 20 bp, Homo Sapiens
  primer_bind 1..20: downstream amplification primer 99-21227 for SEQ 2961, in complement
ggactttggaaaaattaccc

SEQ ID NO: 10827 - DNA, 20 bp, Homo Sapiens
  primer_bind 1..20: downstream amplification primer 99-21229 for SEQ 2962, in complement
tgtacttcaatatatgcagg

SEQ ID NO: 10828 - DNA, 19 bp, Homo Sapiens
  primer_bind 1..19: downstream amplification primer 99-21240 for SEQ 2963, in complement
attcagagttgaaagagag

SEQ ID NO: 10829 - DNA, 19 bp, Homo Sapiens
  primer_bind 1..19: downstream amplification primer 99-21242 for SEQ 2964, in complement
taaacaccatccaagtatc

SEQ ID NO: 10830 - DNA, 21 bp, Homo Sapiens
  primer_bind 1..21: downstream amplification primer 99-21244 for SEQ 2965, in complement
caatctaaaaatgtctccatc

SEQ ID NO: 10831 - DNA, 20 bp, Homo Sapiens
  primer_bind 1..20: downstream amplification primer 99-21252 for SEQ 2966, in complement
tgtgagaagattgatgaagg

SEQ ID NO: 10832 - DNA, 21 bp, Homo Sapiens
  primer_bind 1..21: downstream amplification primer 99-21267 for SEQ 2967, in complement
ataaggaggaatttgtgaaag

SEQ ID NO: 10833 - DNA, 20 bp, Homo Sapiens
  primer_bind 1..20: downstream amplification primer 99-21284 for SEQ 2968, in complement
cctctctaggctggaaagac

SEQ ID NO: 10834 - DNA, 21 bp, Homo Sapiens
  primer_bind 1..21: downstream amplification primer 99-21293 for SEQ 2969, in complement
ctccgaattgtttgacttctg

SEQ ID NO: 10835 - DNA, 21 bp, Homo Sapiens
  primer_bind 1..21: downstream amplification primer 99-21307 for SEQ 2970, in complement
aaggtaacagtggaaaacagg

SEQ ID NO: 10836 - DNA, 21 bp, Homo Sapiens
  primer_bind 1..21: downstream amplification primer 99-21310 for SEQ 2971, in complement
tgacccaccaaggaccataag

SEQ ID NO: 10837 - DNA, 20 bp, Homo Sapiens
  primer_bind 1..20: downstream amplification primer 99-21312 for SEQ 2972, in complement
gtcaaagaggaaataactgg

SEQ ID NO: 10838 - DNA, 21 bp, Homo Sapiens
  primer_bind 1..21: downstream amplification primer 99-21323 for SEQ 2973, in complement
tgaatgatgtgtgtgtgtgag

SEQ ID NO: 10839 - DNA, 21 bp, Homo Sapiens
  primer_bind 1..21: downstream amplification primer 99-21327 for SEQ 2974, in complement
tttacttagcatatcatcacc

SEQ ID NO: 10840 - DNA, 21 bp, Homo Sapiens
  primer_bind 1..21: downstream amplification primer 99-21328 for SEQ 2975, in complement
tgtctccaaaaccacgttttc

SEQ ID NO: 10841 - DNA, 20 bp, Homo Sapiens
  primer_bind 1..20: downstream amplification primer 99-21329 for SEQ 2976, in complement
agagtttattgctttgagag

SEQ ID NO: 10842 - DNA, 21 bp, Homo Sapiens
  primer_bind 1..21: downstream amplification primer 99-21342 for SEQ 2977, in complement
tcattttgagggagtcgtttg

SEQ ID NO: 10843 - DNA, 21 bp, Homo Sapiens
  primer_bind 1..21: downstream amplification primer 99-21346 for SEQ 2978, in complement
aagaaagttgcacaggtgagg

SEQ ID NO: 10844 - DNA, 21 bp, Homo Sapiens
  primer_bind 1..21: downstream amplification primer 99-21360 for SEQ 2979, in complement
actgagggtcttctgtgcttc

SEQ ID NO: 10845 - DNA, 21 bp, Homo Sapiens
  primer_bind 1..21: downstream amplification primer 99-21361 for SEQ 2980, in complement
aagacctaagaaatgacacac

SEQ ID NO: 10846 - DNA, 20 bp, Homo Sapiens
  primer_bind 1..20: downstream amplification primer 99-21377 for SEQ 2981, in complement
gcttcgtttatagtggtttc

SEQ ID NO: 10847 - DNA, 19 bp, Homo Sapiens
  primer_bind 1..19: downstream amplification primer 99-21378 for SEQ 2982, in complement
tagtaagtcagaactgggg

SEQ ID NO: 10848 - DNA, 21 bp, Homo Sapiens
  primer_bind 1..21: downstream amplification primer 99-21391 for SEQ 2983, in complement
cacaggaaagaaggttattag

SEQ ID NO: 10849 - DNA, 21 bp, Homo Sapiens
  primer_bind 1..21: downstream amplification primer 99-21401 for SEQ 2984, in complement
cattagggttatgctgtcttg

SEQ ID NO: 10850 - DNA, 18 bp, Homo Sapiens
  primer_bind 1..18: downstream amplification primer 99-21423 for SEQ 2985, in complement
tgttggggaaattggatg

SEQ ID NO: 10851 - DNA, 20 bp, Homo Sapiens
  primer_bind 1..20: downstream amplification primer 99-21433 for SEQ 2986, in complement
caggagggttttggtcttac

SEQ ID NO: 10852 - DNA, 21 bp, Homo Sapiens
  primer_bind 1..21: downstream amplification primer 99-21441 for SEQ 2987, in complement
gctgcattcaatcactcattc

SEQ ID NO: 10853 - DNA, 20 bp, Homo Sapiens
  primer_bind 1..20: downstream amplification primer 99-21444 for SEQ 2988, in complement
tcctaccttaaatccaatcg

SEQ ID NO: 10854 - DNA, 21 bp, Homo Sapiens
  primer_bind 1..21: downstream amplification primer 99-21448 for SEQ 2989, in complement
accaccctcctacaattttac

SEQ ID NO: 10855 - DNA, 21 bp, Homo Sapiens
  primer_bind 1..21: downstream amplification primer 99-21461 for SEQ 2990, in complement
tgagagaggttagagaggtag

SEQ ID NO: 10856 - DNA, 19 bp, Homo Sapiens
  primer_bind 1..19: downstream amplification primer 99-21463 for SEQ 2991, in complement
acaaacgggatgctgagac

SEQ ID NO: 10857 - DNA, 21 bp, Homo Sapiens
  primer_bind 1..21: downstream amplification primer 99-21465 for SEQ 2992, in complement
gttttcaacctcagcaaagtc

SEQ ID NO: 10858 - DNA, 20 bp, Homo Sapiens
  primer_bind 1..20: downstream amplification primer 99-21486 for SEQ 2993, in complement
gtgatccaagccttcctacc

SEQ ID NO: 10859 - DNA, 20 bp, Homo Sapiens
  primer_bind 1..20: downstream amplification primer 99-21492 for SEQ 2994, in complement
tgtggggagatgagaagagg

SEQ ID NO: 10860 - DNA, 20 bp, Homo Sapiens
  primer_bind 1..20: downstream amplification primer 99-21502 for SEQ 2995, in complement
tcctgacccttggagagaac

SEQ ID NO: 10861 - DNA, 21 bp, Homo Sapiens
  primer_bind 1..21: downstream amplification primer 99-21508 for SEQ 2996, in complement
atttggcacaaattctgttgg

SEQ ID NO: 10862 - DNA, 21 bp, Homo Sapiens
  primer_bind 1..21: downstream amplification primer 99-21510 for SEQ 2997, in complement
ctcttaacagttgtggttttc

SEQ ID NO: 10863 - DNA, 21 bp, Homo Sapiens
  primer_bind 1..21: downstream amplification primer 99-21512 for SEQ 2998, in complement
ttccccctcatttttcccctc

SEQ ID NO: 10864 - DNA, 19 bp, Homo Sapiens
  primer_bind 1..19: downstream amplification primer 99-21516 for SEQ 2999, in complement
aggtgagagagacaagagg

SEQ ID NO: 10865 - DNA, 21 bp, Homo Sapiens
  primer_bind 1..21: downstream amplification primer 99-21533 for SEQ 3000, in complement
agaacaaacctggcacagaag

SEQ ID NO: 10866 - DNA, 21 bp, Homo Sapiens
  primer_bind 1..21: downstream amplification primer 99-21560 for SEQ 3001, in complement
gctattgtaaatagagctgtg

SEQ ID NO: 10867 - DNA, 19 bp, Homo Sapiens
  primer_bind 1..19: downstream amplification primer 99-21561 for SEQ 3002, in complement
ttatatcagtggaaagcag

SEQ ID NO: 10868 - DNA, 20 bp, Homo Sapiens
  primer_bind 1..20: downstream amplification primer 99-21566 for SEQ 3003, in complement
gtgttttgactttcttctcc

SEQ ID NO: 10869 - DNA, 21 bp, Homo Sapiens
  primer_bind 1..21: downstream amplification primer 99-21578 for SEQ 3004, in complement
tgaaagatgtgagccagaaag

SEQ ID NO: 10870 - DNA, 21 bp, Homo Sapiens
  primer_bind 1..21: downstream amplification primer 99-21580 for SEQ 3005, in complement
cttaataaatggagggatgtg

SEQ ID NO: 10871 - DNA, 20 bp, Homo Sapiens
  primer_bind 1..20: downstream amplification primer 99-21591 for SEQ 3006, in complement
cctctctccattgtcactcg

SEQ ID NO: 10872 - DNA, 20 bp, Homo Sapiens
  primer_bind 1..20: downstream amplification primer 99-21592 for SEQ 3007, in complement
ctttccaccatctgcccttg

SEQ ID NO: 10873 - DNA, 21 bp, Homo Sapiens
  primer_bind 1..21: downstream amplification primer 99-21607 for SEQ 3008, in complement
aggactggtctcataaacctg

SEQ ID NO: 10874 - DNA, 21 bp, Homo Sapiens
  primer_bind 1..21: downstream amplification primer 99-21615 for SEQ 3009, in complement
ggaaaaaggagcagagtaagc

SEQ ID NO: 10875 - DNA, 20 bp, Homo Sapiens
  primer_bind 1..20: downstream amplification primer 99-21657 for SEQ 3010, in complement
taacaaaagggagggggctg

SEQ ID NO: 10876 - DNA, 18 bp, Homo Sapiens
  primer_bind 1..18: downstream amplification primer 99-21664 for SEQ 3011, in complement
actcttaggtgccttgac

SEQ ID NO: 10877 - DNA, 21 bp, Homo Sapiens
  primer_bind 1..21: downstream amplification primer 99-21666 for SEQ 3012, in complement
acaaagtgcatctgtggggtc

SEQ ID NO: 10878 - DNA, 21 bp, Homo Sapiens
  primer_bind 1..21: downstream amplification primer 99-21673 for SEQ 3013, in complement
ccaactgctgtaagaaagacc

SEQ ID NO: 10879 - DNA, 18 bp, Homo Sapiens
  primer_bind 1..18: downstream amplification primer 99-21674 for SEQ 3014, in complement
ctgcgaatatgtgtggtg

SEQ ID NO: 10880 - DNA, 21 bp, Homo Sapiens
  primer_bind 1..21: downstream amplification primer 99-21687 for SEQ 3015, in complement
agcaaagacactggagaaggg

SEQ ID NO: 10881 - DNA, 21 bp, Homo Sapiens
  primer_bind 1..21: downstream amplification primer 99-21690 for SEQ 3016, in complement
gaactggatagactaagcaac

SEQ ID NO: 10882 - DNA, 21 bp, Homo Sapiens
  primer_bind 1..21: downstream amplification primer 99-21693 for SEQ 3017, in complement
ctttagagatggactgaatgg

SEQ ID NO: 10883 - DNA, 21 bp, Homo Sapiens
  primer_bind 1..21: downstream amplification primer 99-21699 for SEQ 3018, in complement
aacccaaacctctacatcctc

SEQ ID NO: 10884 - DNA, 21 bp, Homo Sapiens
  primer_bind 1..21: downstream amplification primer 99-21703 for SEQ 3019, in complement
actccccaaaaacatcacccc

SEQ ID NO: 10885 - DNA, 21 bp, Homo Sapiens
  primer_bind 1..21: downstream amplification primer 99-21705 for SEQ 3020, in complement
tgtgaaaagcattggaggtag

SEQ ID NO: 10886 - DNA, 21 bp, Homo Sapiens
  primer_bind 1..21: downstream amplification primer 99-21707 for SEQ 3021, in complement
gcaagctctcaaagtgattcc

SEQ ID NO: 10887 - DNA, 19 bp, Homo Sapiens
  primer_bind 1..19: downstream amplification primer 99-21710 for SEQ 3022, in complement
aaaatccacctcccatccc

SEQ ID NO: 10888 - DNA, 19 bp, Homo Sapiens
  primer_bind 1..19: downstream amplification primer 99-21733 for SEQ 3023, in complement
ctatcccttatctctcatc

SEQ ID NO: 10889 - DNA, 21 bp, Homo Sapiens
  primer_bind 1..21: downstream amplification primer 99-21734 for SEQ 3024, in complement
ttcctgtttgtgggtggtatg

SEQ ID NO: 10890 - DNA, 21 bp, Homo Sapiens
  primer_bind 1..21: downstream amplification primer 99-21742 for SEQ 3025, in complement
aatgggtaagggataaatggg

SEQ ID NO: 10891 - DNA, 21 bp, Homo Sapiens
  primer_bind 1..21: downstream amplification primer 99-21745 for SEQ 3026, in complement
agggtttagatagagtaagag

SEQ ID NO: 10892 - DNA, 21 bp, Homo Sapiens
  primer_bind 1..21: downstream amplification primer 99-21756 for SEQ 3027, in complement
gtttctggcacacaataagag

SEQ ID NO: 10893 - DNA, 20 bp, Homo Sapiens
  primer_bind 1..20: downstream amplification primer 99-21759 for SEQ 3028, in complement
cagatgatctgattgtttgg

SEQ ID NO: 10894 - DNA, 20 bp, Homo Sapiens
  primer_bind 1..20: downstream amplification primer 99-21762 for SEQ 3029, in complement
gcaacctgatctgaactcac

SEQ ID NO: 10895 - DNA, 19 bp, Homo Sapiens
  primer_bind 1..19: downstream amplification primer 99-21763 for SEQ 3030, in complement
taaggggcacactcaccac

SEQ ID NO: 10896 - DNA, 21 bp, Homo Sapiens
  primer_bind 1..21: downstream amplification primer 99-21765 for SEQ 3031, in complement
tggaatagatgtgcctacaac

SEQ ID NO: 10897 - DNA, 21 bp, Homo Sapiens
  primer_bind 1..21: downstream amplification primer 99-21767 for SEQ 3032, in complement
ggaactgctttgatgaacaac

SEQ ID NO: 10898 - DNA, 21 bp, Homo Sapiens
  primer_bind 1..21: downstream amplification primer 99-21771 for SEQ 3033, in complement
tatgagtagataacaggggag

SEQ ID NO: 10899 - DNA, 21 bp, Homo Sapiens
  primer_bind 1..21: downstream amplification primer 99-21775 for SEQ 3034, in complement
cactgtctagcgtattctctc

SEQ ID NO: 10900 - DNA, 21 bp, Homo Sapiens
  primer_bind 1..21: downstream amplification primer 99-21787 for SEQ 3035, in complement
cctggatttgttctttccttg

SEQ ID NO: 10901 - DNA, 21 bp, Homo Sapiens
  primer_bind 1..21: downstream amplification primer 99-21790 for SEQ 3036, in complement
gctcagatgggcttattctac

SEQ ID NO: 10902 - DNA, 20 bp, Homo Sapiens
  primer_bind 1..20: downstream amplification primer 99-21791 for SEQ 3037, in complement
aggaggagggcttgtttctg

SEQ ID NO: 10903 - DNA, 20 bp, Homo Sapiens
  primer_bind 1..20: downstream amplification primer 99-21800 for SEQ 3038, in complement
accaagagcgaacccgaatg

SEQ ID NO: 10904 - DNA, 18 bp, Homo Sapiens
  primer_bind 1..18: downstream amplification primer 99-21801 for SEQ 3039, in complement
tagttaatgcagtctccc

SEQ ID NO: 10905 - DNA, 21 bp, Homo Sapiens
  primer_bind 1..21: downstream amplification primer 99-21804 for SEQ 3040, in complement
tcaaaccccaaagcccttcag

SEQ ID NO: 10906 - DNA, 20 bp, Homo Sapiens
  primer_bind 1..20: downstream amplification primer 99-21810 for SEQ 3041, in complement
gtcactctcttcttcacggg

SEQ ID NO: 10907 - DNA, 21 bp, Homo Sapiens
  primer_bind 1..21: downstream amplification primer 99-21811 for SEQ 3042, in complement
gaatatgaagggggatatgtg

SEQ ID NO: 10908 - DNA, 19 bp, Homo Sapiens
  primer_bind 1..19: downstream amplification primer 99-21827 for SEQ 3043, in complement
tgctttacaagccccaacc

SEQ ID NO: 10909 - DNA, 21 bp, Homo Sapiens
  primer_bind 1..21: downstream amplification primer 99-21829 for SEQ 3044, in complement
aattttcttcctaacccacac

SEQ ID NO: 10910 - DNA, 21 bp, Homo Sapiens
  primer_bind 1..21: downstream amplification primer 99-21831 for SEQ 3045, in complement
ttgctgggaatcttgttgcgg

SEQ ID NO: 10911 - DNA, 21 bp, Homo Sapiens
  primer_bind 1..21: downstream amplification primer 99-21838 for SEQ 3046, in complement
ttcaaataaaatcacatgccc

SEQ ID NO: 10912 - DNA, 19 bp, Homo Sapiens
  primer_bind 1..19: downstream amplification primer 99-21844 for SEQ 3047, in complement
aggtaagtcttgaggctgg

SEQ ID NO: 10913 - DNA, 18 bp, Homo Sapiens
  primer_bind 1..18: downstream amplification primer 99-21846 for SEQ 3048, in complement
tatattgggctttcgtgc

SEQ ID NO: 10914 - DNA, 20 bp, Homo Sapiens
  primer_bind 1..20: downstream amplification primer 99-21874 for SEQ 3049, in complement
tctccagtggggtttggaag

SEQ ID NO: 10915 - DNA, 21 bp, Homo Sapiens
  primer_bind 1..21: downstream amplification primer 99-21880 for SEQ 3050, in complement
tgttcccatctcttcttttcc

SEQ ID NO: 10916 - DNA, 21 bp, Homo Sapiens
  primer_bind 1..21: downstream amplification primer 99-21881 for SEQ 3051, in complement
ccaaacacataccagttggtc

SEQ ID NO: 10917 - DNA, 21 bp, Homo Sapiens
  primer_bind 1..21: downstream amplification primer 99-21889 for SEQ 3052, in complement
ctgacaatcaaaaccatctgc

SEQ ID NO: 10918 - DNA, 20 bp, Homo Sapiens
  primer_bind 1..20: downstream amplification primer 99-21893 for SEQ 3053, in complement
tcattattaccgagtttgag

SEQ ID NO: 10919 - DNA, 20 bp, Homo Sapiens
  primer_bind 1..20: downstream amplification primer 99-21896 for SEQ 3054, in complement
agggaaataaaaggttatgg

SEQ ID NO: 10920 - DNA, 21 bp, Homo Sapiens
  primer_bind 1..21: downstream amplification primer 99-21898 for SEQ 3055, in complement
ccatatctttcctgctttctg

SEQ ID NO: 10921 - DNA, 21 bp, Homo Sapiens
  primer_bind 1..21: downstream amplification primer 99-21901 for SEQ 3056, in complement
gcaacatgagttctagtagcc

SEQ ID NO: 10922 - DNA, 21 bp, Homo Sapiens
  primer_bind 1..21: downstream amplification primer 99-21913 for SEQ 3057, in complement
aaacaaaagcgaagtataggg

SEQ ID NO: 10923 - DNA, 21 bp, Homo Sapiens
  primer_bind 1..21: downstream amplification primer 99-21916 for SEQ 3058, in complement
aaagggtgaactggtgagagg

SEQ ID NO: 10924 - DNA, 20 bp, Homo Sapiens
  primer_bind 1..20: downstream amplification primer 99-21917 for SEQ 3059, in complement
gagaatgtagtaatgaagag

SEQ ID NO: 10925 - DNA, 21 bp, Homo Sapiens
  primer_bind 1..21: downstream amplification primer 99-21919 for SEQ 3060, in complement
atctttttattctcacttccc

SEQ ID NO: 10926 - DNA, 19 bp, Homo Sapiens
  primer_bind 1..19: downstream amplification primer 99-21921 for SEQ 3061, in complement
ccatttgatgggtgtttag

SEQ ID NO: 10927 - DNA, 21 bp, Homo Sapiens
  primer_bind 1..21: downstream amplification primer 99-21943 for SEQ 3062, in complement
tcttcagatttcaggggtcag

SEQ ID NO: 10928 - DNA, 21 bp, Homo Sapiens
  primer_bind 1..21: downstream amplification primer 99-21948 for SEQ 3063, in complement
aagcaaaacaccatctactcc

SEQ ID NO: 10929 - DNA, 18 bp, Homo Sapiens
  primer_bind 1..18: downstream amplification primer 99-21950 for SEQ 3064, in complement
tgtccagtcccatgtaac

SEQ ID NO: 10930 - DNA, 18 bp, Homo Sapiens
  primer_bind 1..18: downstream amplification primer 99-21952 for SEQ 3065, in complement
tccaccgtgttctctatc

SEQ ID NO: 10931 - DNA, 21 bp, Homo Sapiens
  primer_bind 1..21: downstream amplification primer 99-21968 for SEQ 3066, in complement
agctttcactggtttacactc

SEQ ID NO: 10932 - DNA, 21 bp, Homo Sapiens
  primer_bind 1..21: downstream amplification primer 99-21969 for SEQ 3067, in complement
gaaaatgtattgagagatgtg

SEQ ID NO: 10933 - DNA, 18 bp, Homo Sapiens
  primer_bind 1..18: downstream amplification primer 99-22008 for SEQ 3068, in complement
gcctcataccatcttttg

SEQ ID NO: 10934 - DNA, 18 bp, Homo Sapiens
  primer_bind 1..18: downstream amplification primer 99-22098 for SEQ 3069, in complement
gtactgcctttggtactg

SEQ ID NO: 10935 - DNA, 21 bp, Homo Sapiens
  primer_bind 1..21: downstream amplification primer 99-22155 for SEQ 3070, in complement
gtagatagttgtgtttatacc

SEQ ID NO: 10936 - DNA, 21 bp, Homo Sapiens
  primer_bind 1..21: downstream amplification primer 99-22181 for SEQ 3071, in complement
tctgtatgaagagagatttcc

SEQ ID NO: 10937 - DNA, 18 bp, Homo Sapiens
  primer_bind 1..18: downstream amplification primer 99-22187 for SEQ 3072, in complement
gcctctttttcctcactc

SEQ ID NO: 10938 - DNA, 20 bp, Homo Sapiens
  primer_bind 1..20: downstream amplification primer 99-22190 for SEQ 3073, in complement
ctagaactagatgtctcttc

SEQ ID NO: 10939 - DNA, 18 bp, Homo Sapiens
  primer_bind 1..18: downstream amplification primer 99-22202 for SEQ 3074, in complement
tagagagaccaaatggac

SEQ ID NO: 10940 - DNA, 18 bp, Homo Sapiens
  primer_bind 1..18: downstream amplification primer 99-22204 for SEQ 3075, in complement
caggtactaggtgtaagc

SEQ ID NO: 10941 - DNA, 21 bp, Homo Sapiens
  primer_bind 1..21: downstream amplification primer 99-22206 for SEQ 3076, in complement
aattccacaggaaaaaatgac

SEQ ID NO: 10942 - DNA, 19 bp, Homo Sapiens
  primer_bind 1..19: downstream amplification primer 99-22213 for SEQ 3077, in complement
gtatagtagaatcctgttg

SEQ ID NO: 10943 - DNA, 21 bp, Homo Sapiens
  primer_bind 1..21: downstream amplification primer 99-22355 for SEQ 3078, in complement
gctggatgggaaatcaaatgg

SEQ ID NO: 10944 - DNA, 21 bp, Homo Sapiens
  primer_bind 1..21: downstream amplification primer 99-22363 for SEQ 3079, in complement
attgccaagtaaggattccag

SEQ ID NO: 10945 - DNA, 19 bp, Homo Sapiens
  primer_bind 1..19: downstream amplification primer 99-22375 for SEQ 3080, in complement
aaatgtataagttggtggg

SEQ ID NO: 10946 - DNA, 18 bp, Homo Sapiens
  primer_bind 1..18: downstream amplification primer 99-22405 for SEQ 3081, in complement
tccacagtcccaaacatc

SEQ ID NO: 10947 - DNA, 20 bp, Homo Sapiens
  primer_bind 1..20: downstream amplification primer 99-2251 for SEQ 3082, in complement
tgaacatacaaaaacactgg

SEQ ID NO: 10948 - DNA, 21 bp, Homo Sapiens
  primer_bind 1..21: downstream amplification primer 99-22530 for SEQ 3083, in complement
acctagagtttttaagacttg

SEQ ID NO: 10949 - DNA, 21 bp, Homo Sapiens
  primer_bind 1..21: downstream amplification primer 99-22537 for SEQ 3084, in complement
ggtcaatcttttaatcttggg

SEQ ID NO: 10950 - DNA, 19 bp, Homo Sapiens
  primer_bind 1..19: downstream amplification primer 99-22567 for SEQ 3085, in complement
caggcagcagaagtttttg

SEQ ID NO: 10951 - DNA, 20 bp, Homo Sapiens
  primer_bind 1..20: downstream amplification primer 99-22572 for SEQ 3086, in complement
gatctacccttagtttttgg

SEQ ID NO: 10952 - DNA, 18 bp, Homo Sapiens
  primer_bind 1..18: downstream amplification primer 99-22593 for SEQ 3087, in complement
gctttgttttttcccgtc

SEQ ID NO: 10953 - DNA, 21 bp, Homo Sapiens
  primer_bind 1..21: downstream amplification primer 99-22706 for SEQ 3088, in complement
tgttaggtgctcaaagatgtc

SEQ ID NO: 10954 - DNA, 18 bp, Homo Sapiens
  primer_bind 1..18: downstream amplification primer 99-22729 for SEQ 3089, in complement
cacaagaagcagagctac

SEQ ID NO: 10955 - DNA, 19 bp, Homo Sapiens
  primer_bind 1..19: downstream amplification primer 99-22768 for SEQ 3090, in complement
atgccatttagtgcttatc

SEQ ID NO: 10956 - DNA, 21 bp, Homo Sapiens
  primer_bind 1..21: downstream amplification primer 99-22814 for SEQ 3091, in complement
aatttctcctctttaacagac

SEQ ID NO: 10957 - DNA, 21 bp, Homo Sapiens
  primer_bind 1..21: downstream amplification primer 99-22818 for SEQ 3092, in complement
ctgcttatgtagttttgtaac

SEQ ID NO: 10958 - DNA, 20 bp, Homo Sapiens
  primer_bind 1..20: downstream amplification primer 99-22826 for SEQ 3093, in complement
gtacggatattaagttccag

SEQ ID NO: 10959 - DNA, 18 bp, Homo Sapiens
  primer_bind 1..18: downstream amplification primer 99-22851 for SEQ 3094, in complement
agataacaaggagggaag

SEQ ID NO: 10960 - DNA, 18 bp, Homo Sapiens
  primer_bind 1..18: downstream amplification primer 99-23113 for SEQ 3095, in complement
acattagtgatgggacag

SEQ ID NO: 10961 - DNA, 18 bp, Homo Sapiens
  primer_bind 1..18: downstream amplification primer 99-23188 for SEQ 3096, in complement
ttatgagagtaagagggc

SEQ ID NO: 10962 - DNA, 18 bp, Homo Sapiens
  primer_bind 1..18: downstream amplification primer 99-23240 for SEQ 3097, in complement
catgcaaagaacttcacc

SEQ ID NO: 10963 - DNA, 21 bp, Homo Sapiens
  primer_bind 1..21: downstream amplification primer 99-23246 for SEQ 3098, in complement
tttctaggctctgggattagg

SEQ ID NO: 10964 - DNA, 21 bp, Homo Sapiens
  primer_bind 1..21: downstream amplification primer 99-23248 for SEQ 3099, in complement
ggcatcacattgtaaaccgtc

SEQ ID NO: 10965 - DNA, 21 bp, Homo Sapiens
  primer_bind 1..21: downstream amplification primer 99-23249 for SEQ 3100, in complement
tgtctcagtatcaatcgtagg

SEQ ID NO: 10966 - DNA, 18 bp, Homo Sapiens
  primer_bind 1..18: downstream amplification primer 99-23274 for SEQ 3101, in complement
agtctggcactgagaaac

SEQ ID NO: 10967 - DNA, 18 bp, Homo Sapiens
  primer_bind 1..18: downstream amplification primer 99-2333 for SEQ 3102, in complement
ctccactgccacaacttc

SEQ ID NO: 10968 - DNA, 21 bp, Homo Sapiens
  primer_bind 1..21: downstream amplification primer 99-2341 for SEQ 3103, in complement
tgctctgcttgtaatgttatg

SEQ ID NO: 10969 - DNA, 19 bp, Homo Sapiens
  primer_bind 1..19: downstream amplification primer 99-2342 for SEQ 3104, in complement
caaggttgccagtcacatc

SEQ ID NO: 10970 - DNA, 18 bp, Homo Sapiens
  primer_bind 1..18: downstream amplification primer 99-23427 for SEQ 3105, in complement
tcttcatcttctcctccc

SEQ ID NO: 10971 - DNA, 21 bp, Homo Sapiens
  primer_bind 1..21: downstream amplification primer 99-23442 for SEQ 3106, in complement
gagacagctttatcagtgagg

SEQ ID NO: 10972 - DNA, 20 bp, Homo Sapiens
  primer_bind 1..20: downstream amplification primer 99-23544 for SEQ 3107, in complement
ctttgatatgcactttgaac

SEQ ID NO: 10973 - DNA, 21 bp, Homo Sapiens
  primer_bind 1..21: downstream amplification primer 99-23549 for SEQ 3108, in complement
agtagatgaagaagaaagggg

SEQ ID NO: 10974 - DNA, 21 bp, Homo Sapiens
  primer_bind 1..21: downstream amplification primer 99-23558 for SEQ 3109, in complement
atactcatcatcccctcctcc

SEQ ID NO: 10975 - DNA, 20 bp, Homo Sapiens
  primer_bind 1..20: downstream amplification primer 99-23565 for SEQ 3110, in complement
ttccagccccgagtcattag

SEQ ID NO: 10976 - DNA, 20 bp, Homo Sapiens
  primer_bind 1..20: downstream amplification primer 99-23589 for SEQ 3111, in complement
tctgtgcgagattgcctgtc

SEQ ID NO: 10977 - DNA, 21 bp, Homo Sapiens
  primer_bind 1..21: downstream amplification primer 99-23590 for SEQ 3112, in complement
agcaccttgaaaactcgtgac

SEQ ID NO: 10978 - DNA, 21 bp, Homo Sapiens
  primer_bind 1..21: downstream amplification primer 99-23621 for SEQ 3113, in complement
agtgctgggtcagttcagttc

SEQ ID NO: 10979 - DNA, 21 bp, Homo Sapiens
  primer_bind 1..21: downstream amplification primer 99-23641 for SEQ 3114, in complement
ctgccttgtcttttacctctc

SEQ ID NO: 10980 - DNA, 21 bp, Homo Sapiens
  primer_bind 1..21: downstream amplification primer 99-23652 for SEQ 3115, in complement
gatttcattctgtctcccacc

SEQ ID NO: 10981 - DNA, 21 bp, Homo Sapiens
  primer_bind 1..21: downstream amplification primer 99-23696 for SEQ 3116, in complement
actgaatttctctttgcagtg

SEQ ID NO: 10982 - DNA, 21 bp, Homo Sapiens
  primer_bind 1..21: downstream amplification primer 99-23701 for SEQ 3117, in complement
catctgtagctgtatgaagcc

SEQ ID NO: 10983 - DNA, 21 bp, Homo Sapiens
  primer_bind 1..21: downstream amplification primer 99-23702 for SEQ 3118, in complement
agtcatcaatcacccaacgag

SEQ ID NO: 10984 - DNA, 20 bp, Homo Sapiens
  primer_bind 1..20: downstream amplification primer 99-2371 for SEQ 3119, in complement
gcattgaatccgtaaatttc

SEQ ID NO: 10985 - DNA, 18 bp, Homo Sapiens
  primer_bind 1..18: downstream amplification primer 99-23711 for SEQ 3120, in complement
gagcctactggttaattg

SEQ ID NO: 10986 - DNA, 20 bp, Homo Sapiens
  primer_bind 1..20: downstream amplification primer 99-23730 for SEQ 3121, in complement
catagccaaataaattcacc

SEQ ID NO: 10987 - DNA, 18 bp, Homo Sapiens
  primer_bind 1..18: downstream amplification primer 99-23736 for SEQ 3122, in complement
ctaataatcaggagcgtc

SEQ ID NO: 10988 - DNA, 21 bp, Homo Sapiens
  primer_bind 1..21: downstream amplification primer 99-23813 for SEQ 3123, in complement
cttatcactgcaaaacatctc

SEQ ID NO: 10989 - DNA, 20 bp, Homo Sapiens
  primer_bind 1..20: downstream amplification primer 99-23821 for SEQ 3124, in complement
taggtaggggaagcgtcatc

SEQ ID NO: 10990 - DNA, 21 bp, Homo Sapiens
  primer_bind 1..21: downstream amplification primer 99-23844 for SEQ 3125, in complement
ctgggagtatgtatgtgattg

SEQ ID NO: 10991 - DNA, 21 bp, Homo Sapiens
  primer_bind 1..21: downstream amplification primer 99-23858 for SEQ 3126, in complement
agcttttacaaatatgttggg

SEQ ID NO: 10992 - DNA, 20 bp, Homo Sapiens
  primer_bind 1..20: downstream amplification primer 99-23860 for SEQ 3127, in complement
aagccaagagtgagggtgtc

SEQ ID NO: 10993 - DNA, 20 bp, Homo Sapiens
  primer_bind 1..20: downstream amplification primer 99-23876 for SEQ 3128, in complement
aaggatgggtggcaggattc

SEQ ID NO: 10994 - DNA, 21 bp, Homo Sapiens
  primer_bind 1..21: downstream amplification primer 99-23878 for SEQ 3129, in complement
attggcacagggcttacaaag

SEQ ID NO: 10995 - DNA, 21 bp, Homo Sapiens
  primer_bind 1..21: downstream amplification primer 99-23880 for SEQ 3130, in complement
atctctttcatctcatcacac

SEQ ID NO: 10996 - DNA, 21 bp, Homo Sapiens
  primer_bind 1..21: downstream amplification primer 99-23887 for SEQ 3131, in complement
ggaagaattgagaagagcgtg

SEQ ID NO: 10997 - DNA, 21 bp, Homo Sapiens
  primer_bind 1..21: downstream amplification primer 99-23889 for SEQ 3132, in complement
tccactccagttgtagaagtc

SEQ ID NO: 10998 - DNA, 20 bp, Homo Sapiens
  primer_bind 1..20: downstream amplification primer 99-23894 for SEQ 3133, in complement
aacataaaccatccactgag

SEQ ID NO: 10999 - DNA, 20 bp, Homo Sapiens
  primer_bind 1..20: downstream amplification primer 99-23895 for SEQ 3134, in complement
aaaatatccatcttgtcccc

SEQ ID NO: 11000 - DNA, 19 bp, Homo Sapiens
  primer_bind 1..19: downstream amplification primer 99-23902 for SEQ 3135, in complement
tgacctgttggtgtgaagc

SEQ ID NO: 11001 - DNA, 20 bp, Homo Sapiens
  primer_bind 1..20: downstream amplification primer 99-23912 for SEQ 3136, in complement
aagtctcagttccacccacc

SEQ ID NO: 11002 - DNA, 21 bp, Homo Sapiens
  primer_bind 1..21: downstream amplification primer 99-23915 for SEQ 3137, in complement
aaaagacactacccgacattg

SEQ ID NO: 11003 - DNA, 20 bp, Homo Sapiens
  primer_bind 1..20: downstream amplification primer 99-23918 for SEQ 3138, in complement
agcgtgttggtgacatcgag

SEQ ID NO: 11004 - DNA, 21 bp, Homo Sapiens
  primer_bind 1..21: downstream amplification primer 99-23934 for SEQ 3139, in complement
gtgggctgtggtataattgag

SEQ ID NO: 11005 - DNA, 21 bp, Homo Sapiens
  primer_bind 1..21: downstream amplification primer 99-23936 for SEQ 3140, in complement
gtcttaatacagagctttagg

SEQ ID NO: 11006 - DNA, 21 bp, Homo Sapiens
  primer_bind 1..21: downstream amplification primer 99-23938 for SEQ 3141, in complement
aagttttggggttagtggtag

SEQ ID NO: 11007 - DNA, 21 bp, Homo Sapiens
  primer_bind 1..21: downstream amplification primer 99-23943 for SEQ 3142, in complement
aagtgataccttccagtagag

SEQ ID NO: 11008 - DNA, 21 bp, Homo Sapiens
  primer_bind 1..21: downstream amplification primer 99-23960 for SEQ 3143, in complement
ctctacagatgcaaatctgcc

SEQ ID NO: 11009 - DNA, 20 bp, Homo Sapiens
  primer_bind 1..20: downstream amplification primer 99-23965 for SEQ 3144, in complement
gctcttcctaatgtgtaatc

SEQ ID NO: 11010 - DNA, 21 bp, Homo Sapiens
  primer_bind 1..21: downstream amplification primer 99-23977 for SEQ 3145, in complement
gagcctttaaaatatcccccc

SEQ ID NO: 11011 - DNA, 21 bp, Homo Sapiens
  primer_bind 1..21: downstream amplification primer 99-23987 for SEQ 3146, in complement
ctcgattttctgctgacgacc

SEQ ID NO: 11012 - DNA, 21 bp, Homo Sapiens
  primer_bind 1..21: downstream amplification primer 99-23988 for SEQ 3147, in complement
ggtattctgcaagcatctctc

SEQ ID NO: 11013 - DNA, 21 bp, Homo Sapiens
  primer_bind 1..21: downstream amplification primer 99-23995 for SEQ 3148, in complement
aatgatagggggcaatagaac

SEQ ID NO: 11014 - DNA, 21 bp, Homo Sapiens
  primer_bind 1..21: downstream amplification primer 99-24000 for SEQ 3149, in complement
catcctacattcttagtgcag

SEQ ID NO: 11015 - DNA, 20 bp, Homo Sapiens
  primer_bind 1..20: downstream amplification primer 99-24003 for SEQ 3150, in complement
tgggaaaagcctctgtccac

SEQ ID NO: 11016 - DNA, 21 bp, Homo Sapiens
  primer_bind 1..21: downstream amplification primer 99-24004 for SEQ 3151, in complement
gggcacacatgaaactactac

SEQ ID NO: 11017 - DNA, 20 bp, Homo Sapiens
  primer_bind 1..20: downstream amplification primer 99-24007 for SEQ 3152, in complement
aacagcggaggcgaacaaac

SEQ ID NO: 11018 - DNA, 21 bp, Homo Sapiens
  primer_bind 1..21: downstream amplification primer 99-24020 for SEQ 3153, in complement
atgactctgggcagcttttgg

SEQ ID NO: 11019 - DNA, 21 bp, Homo Sapiens
  primer_bind 1..21: downstream amplification primer 99-24038 for SEQ 3154, in complement
aggctaggcaatggacttgac

SEQ ID NO: 11020 - DNA, 21 bp, Homo Sapiens
  primer_bind 1..21: downstream amplification primer 99-24063 for SEQ 3155, in complement
tacctaaccctcatcccttcc

SEQ ID NO: 11021 - DNA, 21 bp, Homo Sapiens
  primer_bind 1..21: downstream amplification primer 99-24073 for SEQ 3156, in complement
gggtttgttagaaagtctggg

SEQ ID NO: 11022 - DNA, 21 bp, Homo Sapiens
  primer_bind 1..21: downstream amplification primer 99-24075 for SEQ 3157, in complement
tgatggttcctgtgtaagctg

SEQ ID NO: 11023 - DNA, 20 bp, Homo Sapiens
  primer_bind 1..20: downstream amplification primer 99-24079 for SEQ 3158, in complement
agcttgtacgttgcctcctc

SEQ ID NO: 11024 - DNA, 20 bp, Homo Sapiens
  primer_bind 1..20: downstream amplification primer 99-24084 for SEQ 3159, in complement
ggttgcttggcatcgcatag

SEQ ID NO: 11025 - DNA, 21 bp, Homo Sapiens
  primer_bind 1..21: downstream amplification primer 99-24092 for SEQ 3160, in complement
ctcaacagaaccccacaagtc

SEQ ID NO: 11026 - DNA, 21 bp, Homo Sapiens
  primer_bind 1..21: downstream amplification primer 99-24096 for SEQ 3161, in complement
gtgaccccaaaaatggatgag

SEQ ID NO: 11027 - DNA, 21 bp, Homo Sapiens
  primer_bind 1..21: downstream amplification primer 99-24105 for SEQ 3162, in complement
ctcagtaaaggcttgggaaac

SEQ ID NO: 11028 - DNA, 21 bp, Homo Sapiens
  primer_bind 1..21: downstream amplification primer 99-24113 for SEQ 3163, in complement
agttgttggatatttggatag

SEQ ID NO: 11029 - DNA, 21 bp, Homo Sapiens
  primer_bind 1..21: downstream amplification primer 99-24117 for SEQ 3164, in complement
aaagacacgttgggcgaaagg

SEQ ID NO: 11030 - DNA, 20 bp, Homo Sapiens
  primer_bind 1..20: downstream amplification primer 99-24119 for SEQ 3165, in complement
atgggggcagttatctcagg

SEQ ID NO: 11031 - DNA, 21 bp, Homo Sapiens
  primer_bind 1..21: downstream amplification primer 99-24123 for SEQ 3166, in complement
atgtgagagtagctgaaatag

SEQ ID NO: 11032 - DNA, 20 bp, Homo Sapiens
  primer_bind 1..20: downstream amplification primer 99-24140 for SEQ 3167, in complement
cctgtttcctcctgttgctg

SEQ ID NO: 11033 - DNA, 21 bp, Homo Sapiens
  primer_bind 1..21: downstream amplification primer 99-24148 for SEQ 3168, in complement
aatgagatcatactgcatggg

SEQ ID NO: 11034 - DNA, 21 bp, Homo Sapiens
  primer_bind 1..21: downstream amplification primer 99-24152 for SEQ 3169, in complement
taggagcccagaaactcaaac

SEQ ID NO: 11035 - DNA, 20 bp, Homo Sapiens
  primer_bind 1..20: downstream amplification primer 99-24155 for SEQ 3170, in complement
tcattccacatagtttcacc

SEQ ID NO: 11036 - DNA, 19 bp, Homo Sapiens
  primer_bind 1..19: downstream amplification primer 99-24156 for SEQ 3171, in complement
aaagtgctagacccagacg

SEQ ID NO: 11037 - DNA, 21 bp, Homo Sapiens
  primer_bind 1..21: downstream amplification primer 99-24167 for SEQ 3172, in complement
acagaaagggtttcaggtgag

SEQ ID NO: 11038 - DNA, 21 bp, Homo Sapiens
  primer_bind 1..21: downstream amplification primer 99-24175 for SEQ 3173, in complement
tgtttattttgaggggcagag

SEQ ID NO: 11039 - DNA, 21 bp, Homo Sapiens
  primer_bind 1..21: downstream amplification primer 99-24180 for SEQ 3174, in complement
ggatgctggcataagagaaag

SEQ ID NO: 11040 - DNA, 21 bp, Homo Sapiens
  primer_bind 1..21: downstream amplification primer 99-24182 for SEQ 3175, in complement
atgtatcctcaactatatctc

SEQ ID NO: 11041 - DNA, 21 bp, Homo Sapiens
  primer_bind 1..21: downstream amplification primer 99-24185 for SEQ 3176, in complement
atgggattccccaggagaaag

SEQ ID NO: 11042 - DNA, 21 bp, Homo Sapiens
  primer_bind 1..21: downstream amplification primer 99-24187 for SEQ 3177, in complement
caacatacgatagttctttgg

SEQ ID NO: 11043 - DNA, 21 bp, Homo Sapiens
  primer_bind 1..21: downstream amplification primer 99-24190 for SEQ 3178, in complement
gcttgaaggaagagtccattg

SEQ ID NO: 11044 - DNA, 21 bp, Homo Sapiens
  primer_bind 1..21: downstream amplification primer 99-24202 for SEQ 3179, in complement
ttgagaaactggaagatgagg

SEQ ID NO: 11045 - DNA, 20 bp, Homo Sapiens
  primer_bind 1..20: downstream amplification primer 99-24204 for SEQ 3180, in complement
agccaattccagagtagggg

SEQ ID NO: 11046 - DNA, 20 bp, Homo Sapiens
  primer_bind 1..20: downstream amplification primer 99-24208 for SEQ 3181, in complement
aggctctacagcaatggctc

SEQ ID NO: 11047 - DNA, 20 bp, Homo Sapiens
  primer_bind 1..20: downstream amplification primer 99-24210 for SEQ 3182, in complement
tgagcgacaggagtagttgc

SEQ ID NO: 11048 - DNA, 21 bp, Homo Sapiens
  primer_bind 1..21: downstream amplification primer 99-24217 for SEQ 3183, in complement
tgtaaacagcagccaagagtc

SEQ ID NO: 11049 - DNA, 21 bp, Homo Sapiens
  primer_bind 1..21: downstream amplification primer 99-24225 for SEQ 3184, in complement
ttcgaggaggtgattgtgagg

SEQ ID NO: 11050 - DNA, 21 bp, Homo Sapiens
  primer_bind 1..21: downstream amplification primer 99-24228 for SEQ 3185, in complement
acactgccaggtggttgtttc

SEQ ID NO: 11051 - DNA, 21 bp, Homo Sapiens
  primer_bind 1..21: downstream amplification primer 99-24232 for SEQ 3186, in complement
tgaggttcagagaggcatcag

SEQ ID NO: 11052 - DNA, 21 bp, Homo Sapiens
  primer_bind 1..21: downstream amplification primer 99-24234 for SEQ 3187, in complement
aaggaaactccagccccaatg

SEQ ID NO: 11053 - DNA, 21 bp, Homo Sapiens
  primer_bind 1..21: downstream amplification primer 99-24369 for SEQ 3188, in complement
taaagatgagtaaaacagacc

SEQ ID NO: 11054 - DNA, 19 bp, Homo Sapiens
  primer_bind 1..19: downstream amplification primer 99-24397 for SEQ 3189, in complement
cactgtcagaatagaaatg

SEQ ID NO: 11055 - DNA, 18 bp, Homo Sapiens
  primer_bind 1..18: downstream amplification primer 99-24408 for SEQ 3190, in complement
tcctgaccccctaattac

SEQ ID NO: 11056 - DNA, 20 bp, Homo Sapiens
  primer_bind 1..20: downstream amplification primer 99-2441 for SEQ 3191, in complement
cccttccctactttaaattc

SEQ ID NO: 11057 - DNA, 21 bp, Homo Sapiens
  primer_bind 1..21: downstream amplification primer 99-24412 for SEQ 3192, in complement
atgtggaagagtcatcttggg

SEQ ID NO: 11058 - DNA, 18 bp, Homo Sapiens
  primer_bind 1..18: downstream amplification primer 99-24415 for SEQ 3193, in complement
caacccaatttcttcctc

SEQ ID NO: 11059 - DNA, 19 bp, Homo Sapiens
  primer_bind 1..19: downstream amplification primer 99-24470 for SEQ 3194, in complement
tctagcatttagattcctg

SEQ ID NO: 11060 - DNA, 19 bp, Homo Sapiens
  primer_bind 1..19: downstream amplification primer 99-24472 for SEQ 3195, in complement
agtttcttttgcttctagg

SEQ ID NO: 11061 - DNA, 20 bp, Homo Sapiens
  primer_bind 1..20: downstream amplification primer 99-24480 for SEQ 3196, in complement
ggtgaaactgaatctcaatg

SEQ ID NO: 11062 - DNA, 18 bp, Homo Sapiens
  primer_bind 1..18: downstream amplification primer 99-24485 for SEQ 3197, in complement
gctgcttcatctgataac

SEQ ID NO: 11063 - DNA, 21 bp, Homo Sapiens
  primer_bind 1..21: downstream amplification primer 99-24490 for SEQ 3198, in complement
aatgaggagagagagaagtgg

SEQ ID NO: 11064 - DNA, 18 bp, Homo Sapiens
  primer_bind 1..18: downstream amplification primer 99-24492 for SEQ 3199, in complement
tctcccttccaaatcctc

SEQ ID NO: 11065 - DNA, 18 bp, Homo Sapiens
  primer_bind 1..18: downstream amplification primer 99-24581 for SEQ 3200, in complement
tactgctagttcaagctc

SEQ ID NO: 11066 - DNA, 20 bp, Homo Sapiens
  primer_bind 1..20: downstream amplification primer 99-24591 for SEQ 3201, in complement
tgctccttcccatttttatc

SEQ ID NO: 11067 - DNA, 19 bp, Homo Sapiens
  primer_bind 1..19: downstream amplification primer 99-24592 for SEQ 3202, in complement
tggtgagtagtaacttatg

SEQ ID NO: 11068 - DNA, 21 bp, Homo Sapiens
  primer_bind 1..21: downstream amplification primer 99-24745 for SEQ 3203, in complement
aatgttccgagctgtatgacc

SEQ ID NO: 11069 - DNA, 18 bp, Homo Sapiens
  primer_bind 1..18: downstream amplification primer 99-24753 for SEQ 3204, in complement
attccagcacatggagag

SEQ ID NO: 11070 - DNA, 21 bp, Homo Sapiens
  primer_bind 1..21: downstream amplification primer 99-24768 for SEQ 3205, in complement
catctgtagctgtatgaagcc

SEQ ID NO: 11071 - DNA, 19 bp, Homo Sapiens
  primer_bind 1..19: downstream amplification primer 99-24855 for SEQ 3206, in complement
acctggctgacctattcac

SEQ ID NO: 11072 - DNA, 21 bp, Homo Sapiens
  primer_bind 1..21: downstream amplification primer 99-24863 for SEQ 3207, in complement
gaagtgttgaagaagagagag

SEQ ID NO: 11073 - DNA, 21 bp, Homo Sapiens
  primer_bind 1..21: downstream amplification primer 99-24867 for SEQ 3208, in complement
ctccatccaagaaagactcac

SEQ ID NO: 11074 - DNA, 21 bp, Homo Sapiens
  primer_bind 1..21: downstream amplification primer 99-24871 for SEQ 3209, in complement
atacatctgtgttagctgttc

SEQ ID NO: 11075 - DNA, 21 bp, Homo Sapiens
  primer_bind 1..21: downstream amplification primer 99-24889 for SEQ 3210, in complement
tatactatggaggcaggaagg

SEQ ID NO: 11076 - DNA, 20 bp, Homo Sapiens
  primer_bind 1..20: downstream amplification primer 99-24897 for SEQ 3211, in complement
atgtggggaagatggacctg

SEQ ID NO: 11077 - DNA, 18 bp, Homo Sapiens
  primer_bind 1..18: downstream amplification primer 99-24904 for SEQ 3212, in complement
ttgtactaagcctgtcac

SEQ ID NO: 11078 - DNA, 21 bp, Homo Sapiens
  primer_bind 1..21: downstream amplification primer 99-24909 for SEQ 3213, in complement
gtgttggagagagagagattg

SEQ ID NO: 11079 - DNA, 20 bp, Homo Sapiens
  primer_bind 1..20: downstream amplification primer 99-24917 for SEQ 3214, in complement
attcaatacatctgatgggg

SEQ ID NO: 11080 - DNA, 21 bp, Homo Sapiens
  primer_bind 1..21: downstream amplification primer 99-24930 for SEQ 3215, in complement
taggttctttaggctatgatg

SEQ ID NO: 11081 - DNA, 18 bp, Homo Sapiens
  primer_bind 1..18: downstream amplification primer 99-24936 for SEQ 3216, in complement
aatcccagagatttccag

SEQ ID NO: 11082 - DNA, 20 bp, Homo Sapiens
  primer_bind 1..20: downstream amplification primer 99-24965 for SEQ 3217, in complement
gggatgaggaaagctgtgtg

SEQ ID NO: 11083 - DNA, 21 bp, Homo Sapiens
  primer_bind 1..21: downstream amplification primer 99-24966 for SEQ 3218, in complement
ctcaaatagccaccttagcac

SEQ ID NO: 11084 - DNA, 18 bp, Homo Sapiens
  primer_bind 1..18: downstream amplification primer 99-25020 for SEQ 3219, in complement
acatcacaccttcctcac

SEQ ID NO: 11085 - DNA, 18 bp, Homo Sapiens
  primer_bind 1..18: downstream amplification primer 99-25362 for SEQ 3220, in complement
tcatatccccaacagttc

SEQ ID NO: 11086 - DNA, 18 bp, Homo Sapiens
  primer_bind 1..18: downstream amplification primer 99-25394 for SEQ 3221, in complement
aagacagaggtaagagag

SEQ ID NO: 11087 - DNA, 18 bp, Homo Sapiens
  primer_bind 1..18: downstream amplification primer 99-25406 for SEQ 3222, in complement
tgaacaagatgccatgac

SEQ ID NO: 11088 - DNA, 21 bp, Homo Sapiens
  primer_bind 1..21: downstream amplification primer 99-25446 for SEQ 3223, in complement
taaggttaaggtcagagtcgg

SEQ ID NO: 11089 - DNA, 21 bp, Homo Sapiens
  primer_bind 1..21: downstream amplification primer 99-25496 for SEQ 3224, in complement
tcctgctaatgatactaaaac

SEQ ID NO: 11090 - DNA, 19 bp, Homo Sapiens
  primer_bind 1..19: downstream amplification primer 99-25497 for SEQ 3225, in complement
cacagtatgtgaaagatcc

SEQ ID NO: 11091 - DNA, 19 bp, Homo Sapiens
  primer_bind 1..19: downstream amplification primer 99-2559 for SEQ 3226, in complement
cctacggtttgtcataaag

SEQ ID NO: 11092 - DNA, 21 bp, Homo Sapiens
  primer_bind 1..21: downstream amplification primer 99-25654 for SEQ 3227, in complement
ctcaggtggctaattttacag

SEQ ID NO: 11093 - DNA, 21 bp, Homo Sapiens
  primer_bind 1..21: downstream amplification primer 99-2566 for SEQ 3228, in complement
tgtaacaggggacatgggaag

SEQ ID NO: 11094 - DNA, 20 bp, Homo Sapiens
  primer_bind 1..20: downstream amplification primer 99-2567 for SEQ 3229, in complement
caattttgtatggatgacag

SEQ ID NO: 11095 - DNA, 21 bp, Homo Sapiens
  primer_bind 1..21: downstream amplification primer 99-2571 for SEQ 3230, in complement
ctataactcttatcagtgaac

SEQ ID NO: 11096 - DNA, 21 bp, Homo Sapiens
  primer_bind 1..21: downstream amplification primer 99-25738 for SEQ 3231, in complement
gtattagatagggttttgagg

SEQ ID NO: 11097 - DNA, 21 bp, Homo Sapiens
  primer_bind 1..21: downstream amplification primer 99-25755 for SEQ 3232, in complement
gaattggcaaaacaagaaaag

SEQ ID NO: 11098 - DNA, 18 bp, Homo Sapiens
  primer_bind 1..18: downstream amplification primer 99-25834 for SEQ 3233, in complement
gagaagccttaggtaatg

SEQ ID NO: 11099 - DNA, 21 bp, Homo Sapiens
  primer_bind 1..21: downstream amplification primer 99-25843 for SEQ 3234, in complement
ctcactagaacatctgcttgg

SEQ ID NO: 11100 - DNA, 21 bp, Homo Sapiens
  primer_bind 1..21: downstream amplification primer 99-26051 for SEQ 3235, in complement
gctctatgatatttttgatgg

SEQ ID NO: 11101 - DNA, 19 bp, Homo Sapiens
  primer_bind 1..19: downstream amplification primer 99-26058 for SEQ 3236, in complement
gcaatgaatagcaagatcc

SEQ ID NO: 11102 - DNA, 20 bp, Homo Sapiens
  primer_bind 1..20: downstream amplification primer 99-26074 for SEQ 3237, in complement
atttacccagcagttaagag

SEQ ID NO: 11103 - DNA, 18 bp, Homo Sapiens
  primer_bind 1..18: downstream amplification primer 99-26076 for SEQ 3238, in complement
aggtttgggaaggatgtg

SEQ ID NO: 11104 - DNA, 18 bp, Homo Sapiens
  primer_bind 1..18: downstream amplification primer 99-2630 for SEQ 3239, in complement
ggtttgtgttcagtacgg

SEQ ID NO: 11105 - DNA, 21 bp, Homo Sapiens
  primer_bind 1..21: downstream amplification primer 99-2633 for SEQ 3240, in complement
tgtatatgcctggtggaaatg

SEQ ID NO: 11106 - DNA, 21 bp, Homo Sapiens
  primer_bind 1..21: downstream amplification primer 99-2634 for SEQ 3241, in complement
gtgaaagaaacttgatagagg

SEQ ID NO: 11107 - DNA, 21 bp, Homo Sapiens
  primer_bind 1..21: downstream amplification primer 99-2636 for SEQ 3242, in complement
atagaggaacagagagaatag

SEQ ID NO: 11108 - DNA, 20 bp, Homo Sapiens
  primer_bind 1..20: downstream amplification primer 99-2642 for SEQ 3243, in complement
cagaaccattaactattcac

SEQ ID NO: 11109 - DNA, 20 bp, Homo Sapiens
  primer_bind 1..20: downstream amplification primer 99-2645 for SEQ 3244, in complement
gccatttggaattttgatag

SEQ ID NO: 11110 - DNA, 19 bp, Homo Sapiens
  primer_bind 1..19: downstream amplification primer 99-2647 for SEQ 3245, in complement
tgcagcatccctggaagtc

SEQ ID NO: 11111 - DNA, 21 bp, Homo Sapiens
  primer_bind 1..21: downstream amplification primer 99-2649 for SEQ 3246, in complement
gagacatcatatctgtgtttg

SEQ ID NO: 11112 - DNA, 18 bp, Homo Sapiens
  primer_bind 1..18: downstream amplification primer 99-2711 for SEQ 3247, in complement
acacatacacccacctac

SEQ ID NO: 11113 - DNA, 20 bp, Homo Sapiens
  primer_bind 1..20: downstream amplification primer 99-2712 for SEQ 3248, in complement
gtcaagagcaaaaaaacccc

SEQ ID NO: 11114 - DNA, 20 bp, Homo Sapiens
  primer_bind 1..20: downstream amplification primer 99-2718 for SEQ 3249, in complement
tggcatctgagtgggtatgg

SEQ ID NO: 11115 - DNA, 18 bp, Homo Sapiens
  primer_bind 1..18: downstream amplification primer 99-2719 for SEQ 3250, in complement
tgcagggaagggtataac

SEQ ID NO: 11116 - DNA, 21 bp, Homo Sapiens
  primer_bind 1..21: downstream amplification primer 99-2726 for SEQ 3251, in complement
ttgtctcactggtatcttctc

SEQ ID NO: 11117 - DNA, 19 bp, Homo Sapiens
  primer_bind 1..19: downstream amplification primer 99-2734 for SEQ 3252, in complement
taaataggtgggggggttg

SEQ ID NO: 11118 - DNA, 19 bp, Homo Sapiens
  primer_bind 1..19: downstream amplification primer 99-2740 for SEQ 3253, in complement
ttctaactcaaatccactc

SEQ ID NO: 11119 - DNA, 18 bp, Homo Sapiens
  primer_bind 1..18: downstream amplification primer 99-2752 for SEQ 3254, in complement
aggtcttatgggcatctg

SEQ ID NO: 11120 - DNA, 18 bp, Homo Sapiens
  primer_bind 1..18: downstream amplification primer 99-2760 for SEQ 3255, in complement
agagttgagcgtggaaag

SEQ ID NO: 11121 - DNA, 18 bp, Homo Sapiens
  primer_bind 1..18: downstream amplification primer 99-2761 for SEQ 3256, in complement
tctctaggaagggataac

SEQ ID NO: 11122 - DNA, 18 bp, Homo Sapiens
  primer_bind 1..18: downstream amplification primer 99-2765 for SEQ 3257, in complement
catgtaaacagttgcagc

SEQ ID NO: 11123 - DNA, 18 bp, Homo Sapiens
  primer_bind 1..18: downstream amplification primer 99-2790 for SEQ 3258, in complement
cccagataatctctccac

SEQ ID NO: 11124 - DNA, 21 bp, Homo Sapiens
  primer_bind 1..21: downstream amplification primer 99-2797 for SEQ 3259, in complement
ggggtggttgaaatcattagg

SEQ ID NO: 11125 - DNA, 21 bp, Homo Sapiens
  primer_bind 1..21: downstream amplification primer 99-2816 for SEQ 3260, in complement
tttcagtgtccgatggagaag

SEQ ID NO: 11126 - DNA, 21 bp, Homo Sapiens
  primer_bind 1..21: downstream amplification primer 99-2817 for SEQ 3261, in complement
ttctgatgccgaaatccccac

SEQ ID NO: 11127 - DNA, 20 bp, Homo Sapiens
  primer_bind 1..20: downstream amplification primer 99-2819 for SEQ 3262, in complement
cagccctataaatagtcatc

SEQ ID NO: 11128 - DNA, 21 bp, Homo Sapiens
  primer_bind 1..21: downstream amplification primer 99-2820 for SEQ 3263, in complement
actgattgacgctctctctcc

SEQ ID NO: 11129 - DNA, 21 bp, Homo Sapiens
  primer_bind 1..21: downstream amplification primer 99-2832 for SEQ 3264, in complement
tgaagacatttggaagtgagg

SEQ ID NO: 11130 - DNA, 21 bp, Homo Sapiens
  primer_bind 1..21: downstream amplification primer 99-2868 for SEQ 3265, in complement
tagagtggagagggctatttg

SEQ ID NO: 11131 - DNA, 18 bp, Homo Sapiens
  primer_bind 1..18: downstream amplification primer 99-2870 for SEQ 3266, in complement
gacttgtctacagcacac

SEQ ID NO: 11132 - DNA, 18 bp, Homo Sapiens
  primer_bind 1..18: downstream amplification primer 99-2881 for SEQ 3267, in complement
gcttcattctaagcatgg

SEQ ID NO: 11133 - DNA, 20 bp, Homo Sapiens
  primer_bind 1..20: downstream amplification primer 99-2895 for SEQ 3268, in complement
catgctaaactgaacagcac

SEQ ID NO: 11134 - DNA, 20 bp, Homo Sapiens
  primer_bind 1..20: downstream amplification primer 99-2903 for SEQ 3269, in complement
ggaagggagttatttataag

SEQ ID NO: 11135 - DNA, 18 bp, Homo Sapiens
  primer_bind 1..18: downstream amplification primer 99-2906 for SEQ 3270, in complement
gttcaactaggtcaggtc

SEQ ID NO: 11136 - DNA, 18 bp, Homo Sapiens
  primer_bind 1..18: downstream amplification primer 99-2914 for SEQ 3271, in complement
aggggtgaattttcgttg

SEQ ID NO: 11137 - DNA, 21 bp, Homo Sapiens
  primer_bind 1..21: downstream amplification primer 99-2922 for SEQ 3272, in complement
tagagcttcttgatctggttg

SEQ ID NO: 11138 - DNA, 18 bp, Homo Sapiens
  primer_bind 1..18: downstream amplification primer 99-2924 for SEQ 3273, in complement
ggtcacaggaaatcatag

SEQ ID NO: 11139 - DNA, 21 bp, Homo Sapiens
  primer_bind 1..21: downstream amplification primer 99-2926 for SEQ 3274, in complement
tttcttctctactcatcactc

SEQ ID NO: 11140 - DNA, 21 bp, Homo Sapiens
  primer_bind 1..21: downstream amplification primer 99-2928 for SEQ 3275, in complement
ctctatccctttcttcagttc

SEQ ID NO: 11141 - DNA, 21 bp, Homo Sapiens
  primer_bind 1..21: downstream amplification primer 99-2938 for SEQ 3276, in complement
aggacaaaaatcatttgctgg

SEQ ID NO: 11142 - DNA, 20 bp, Homo Sapiens
  primer_bind 1..20: downstream amplification primer 99-2943 for SEQ 3277, in complement
aaggagcatagagaaggcac

SEQ ID NO: 11143 - DNA, 21 bp, Homo Sapiens
  primer_bind 1..21: downstream amplification primer 99-2944 for SEQ 3278, in complement
gagtagttggaatttgtaagg

SEQ ID NO: 11144 - DNA, 18 bp, Homo Sapiens
  primer_bind 1..18: downstream amplification primer 99-295 for SEQ 3279, in complement
ttggatagattgcgtggg

SEQ ID NO: 11145 - DNA, 19 bp, Homo Sapiens
  primer_bind 1..19: downstream amplification primer 99-2954 for SEQ 3280, in complement
tcacccagaaactcaagcc

SEQ ID NO: 11146 - DNA, 18 bp, Homo Sapiens
  primer_bind 1..18: downstream amplification primer 99-2956 for SEQ 3281, in complement
cttatcatcactcttccc

SEQ ID NO: 11147 - DNA, 21 bp, Homo Sapiens
  primer_bind 1..21: downstream amplification primer 99-2970 for SEQ 3282, in complement
tgtgctctgagactcttaatg

SEQ ID NO: 11148 - DNA, 21 bp, Homo Sapiens
  primer_bind 1..21: downstream amplification primer 99-2978 for SEQ 3283, in complement
agaagaataagaagatttggg

SEQ ID NO: 11149 - DNA, 19 bp, Homo Sapiens
  primer_bind 1..19: downstream amplification primer 99-2981 for SEQ 3284, in complement
ctgataacattttcttccc

SEQ ID NO: 11150 - DNA, 21 bp, Homo Sapiens
  primer_bind 1..21: downstream amplification primer 99-2988 for SEQ 3285, in complement
aactggcttcttgatttttgg

SEQ ID NO: 11151 - DNA, 18 bp, Homo Sapiens
  primer_bind 1..18: downstream amplification primer 99-2989 for SEQ 3286, in complement
tctcccccccttttattc

SEQ ID NO: 11152 - DNA, 20 bp, Homo Sapiens
  primer_bind 1..20: downstream amplification primer 99-2991 for SEQ 3287, in complement
gaagcaagaagtattatcag

SEQ ID NO: 11153 - DNA, 21 bp, Homo Sapiens
  primer_bind 1..21: downstream amplification primer 99-2995 for SEQ 3288, in complement
acttcatatctcccaaaattc

SEQ ID NO: 11154 - DNA, 20 bp, Homo Sapiens
  primer_bind 1..20: downstream amplification primer 99-2999 for SEQ 3289, in complement
caatttttactacacccaac

SEQ ID NO: 11155 - DNA, 21 bp, Homo Sapiens
  primer_bind 1..21: downstream amplification primer 99-3013 for SEQ 3290, in complement
accccacttttcctcactctc

SEQ ID NO: 11156 - DNA, 21 bp, Homo Sapiens
  primer_bind 1..21: downstream amplification primer 99-3018 for SEQ 3291, in complement
caggctgagtggtaaatgtgg

SEQ ID NO: 11157 - DNA, 21 bp, Homo Sapiens
  primer_bind 1..21: downstream amplification primer 99-3019 for SEQ 3292, in complement
aacatgcagagatttccatag

SEQ ID NO: 11158 - DNA, 18 bp, Homo Sapiens
  primer_bind 1..18: downstream amplification primer 99-3020 for SEQ 3293, in complement
gggattgctctaaatcac

SEQ ID NO: 11159 - DNA, 21 bp, Homo Sapiens
  primer_bind 1..21: downstream amplification primer 99-3021 for SEQ 3294, in complement
ataggaatatctggttcaagg

SEQ ID NO: 11160 - DNA, 18 bp, Homo Sapiens
  primer_bind 1..18: downstream amplification primer 99-3044 for SEQ 3295, in complement
tctatgttccttctcctc

SEQ ID NO: 11161 - DNA, 18 bp, Homo Sapiens
  primer_bind 1..18: downstream amplification primer 99-3045 for SEQ 3296, in complement
gatgggtgatgttggttg

SEQ ID NO: 11162 - DNA, 20 bp, Homo Sapiens
  primer_bind 1..20: downstream amplification primer 99-3046 for SEQ 3297, in complement
gaaaggtagaatgatagagc

SEQ ID NO: 11163 - DNA, 18 bp, Homo Sapiens
  primer_bind 1..18: downstream amplification primer 99-3047 for SEQ 3298, in complement
cataacagtcagacatgg

SEQ ID NO: 11164 - DNA, 21 bp, Homo Sapiens
  primer_bind 1..21: downstream amplification primer 99-3058 for SEQ 3299, in complement
aagagatggaggaagatagag

SEQ ID NO: 11165 - DNA, 18 bp, Homo Sapiens
  primer_bind 1..18: downstream amplification primer 99-306 for SEQ 3300, in complement
tgctatttgacaagcctg

SEQ ID NO: 11166 - DNA, 21 bp, Homo Sapiens
  primer_bind 1..21: downstream amplification primer 99-3061 for SEQ 3301, in complement
ccaacttcagtgtaatatttc

SEQ ID NO: 11167 - DNA, 21 bp, Homo Sapiens
  primer_bind 1..21: downstream amplification primer 99-3106 for SEQ 3302, in complement
gccagacagcaacaatgatac

SEQ ID NO: 11168 - DNA, 21 bp, Homo Sapiens
  primer_bind 1..21: downstream amplification primer 99-3108 for SEQ 3303, in complement
cccaaacatcactttttaaac

SEQ ID NO: 11169 - DNA, 21 bp, Homo Sapiens
  primer_bind 1..21: downstream amplification primer 99-3109 for SEQ 3304, in complement
cagaaatactggtgaatgtgg

SEQ ID NO: 11170 - DNA, 19 bp, Homo Sapiens
  primer_bind 1..19: downstream amplification primer 99-3110 for SEQ 3305, in complement
tatcatttctcacacaacc

SEQ ID NO: 11171 - DNA, 20 bp, Homo Sapiens
  primer_bind 1..20: downstream amplification primer 99-312 for SEQ 3306, in complement
ttcatgtcgatgagcagggg

SEQ ID NO: 11172 - DNA, 21 bp, Homo Sapiens
  primer_bind 1..21: downstream amplification primer 99-3129 for SEQ 3307, in complement
cctgcaacatttcctttgctc

SEQ ID NO: 11173 - DNA, 20 bp, Homo Sapiens
  primer_bind 1..20: downstream amplification primer 99-3132 for SEQ 3308, in complement
taaagacccagcaccaggag

SEQ ID NO: 11174 - DNA, 18 bp, Homo Sapiens
  primer_bind 1..18: downstream amplification primer 99-3144 for SEQ 3309, in complement
ggtgaaggaaggaagaag

SEQ ID NO: 11175 - DNA, 18 bp, Homo Sapiens
  primer_bind 1..18: downstream amplification primer 99-3147 for SEQ 3310, in complement
aaacacagcaggactgac

SEQ ID NO: 11176 - DNA, 19 bp, Homo Sapiens
  primer_bind 1..19: downstream amplification primer 99-3153 for SEQ 3311, in complement
aacctcctctcctcctttg

SEQ ID NO: 11177 - DNA, 21 bp, Homo Sapiens
  primer_bind 1..21: downstream amplification primer 99-3154 for SEQ 3312, in complement
tggggtataaggtaatggctc

SEQ ID NO: 11178 - DNA, 20 bp, Homo Sapiens
  primer_bind 1..20: downstream amplification primer 99-3156 for SEQ 3313, in complement
aacggatattttgagcacac

SEQ ID NO: 11179 - DNA, 19 bp, Homo Sapiens
  primer_bind 1..19: downstream amplification primer 99-3167 for SEQ 3314, in complement
agccttctcttctctcctg

SEQ ID NO: 11180 - DNA, 18 bp, Homo Sapiens
  primer_bind 1..18: downstream amplification primer 99-3195 for SEQ 3315, in complement
atccagacacacaatccc

SEQ ID NO: 11181 - DNA, 18 bp, Homo Sapiens
  primer_bind 1..18: downstream amplification primer 99-3217 for SEQ 3316, in complement
tcagacccccaataaaac

SEQ ID NO: 11182 - DNA, 18 bp, Homo Sapiens
  primer_bind 1..18: downstream amplification primer 99-3224 for SEQ 3317, in complement
gcctttccttagcaatac

SEQ ID NO: 11183 - DNA, 18 bp, Homo Sapiens
  primer_bind 1..18: downstream amplification primer 99-3231 for SEQ 3318, in complement
taccctcctaccaaactc

SEQ ID NO: 11184 - DNA, 21 bp, Homo Sapiens
  primer_bind 1..21: downstream amplification primer 99-3234 for SEQ 3319, in complement
aaaggtagagagtattggtag

SEQ ID NO: 11185 - DNA, 20 bp, Homo Sapiens
  primer_bind 1..20: downstream amplification primer 99-325 for SEQ 3320, in complement
agactgtgccctacctaacc

SEQ ID NO: 11186 - DNA, 19 bp, Homo Sapiens
  primer_bind 1..19: downstream amplification primer 99-3266 for SEQ 3321, in complement
tcagtgctttggacggttc

SEQ ID NO: 11187 - DNA, 21 bp, Homo Sapiens
  primer_bind 1..21: downstream amplification primer 99-3276 for SEQ 3322, in complement
aatccttacagccaccctctc

SEQ ID NO: 11188 - DNA, 18 bp, Homo Sapiens
  primer_bind 1..18: downstream amplification primer 99-3279 for SEQ 3323, in complement
ttctggttattcgtgagg

SEQ ID NO: 11189 - DNA, 18 bp, Homo Sapiens
  primer_bind 1..18: downstream amplification primer 99-3293 for SEQ 3324, in complement
tctgagcatgtactctgg

SEQ ID NO: 11190 - DNA, 21 bp, Homo Sapiens
  primer_bind 1..21: downstream amplification primer 99-3296 for SEQ 3325, in complement
cagggcatgaagatttcccag

SEQ ID NO: 11191 - DNA, 20 bp, Homo Sapiens
  primer_bind 1..20: downstream amplification primer 99-3299 for SEQ 3326, in complement
gtttctgtcttatcaagtgg

SEQ ID NO: 11192 - DNA, 21 bp, Homo Sapiens
  primer_bind 1..21: downstream amplification primer 99-3305 for SEQ 3327, in complement
tgataagtgctatgaagtggg

SEQ ID NO: 11193 - DNA, 18 bp, Homo Sapiens
  primer_bind 1..18: downstream amplification primer 99-3335 for SEQ 3328, in complement
gtctggttttggtattgg

SEQ ID NO: 11194 - DNA, 21 bp, Homo Sapiens
  primer_bind 1..21: downstream amplification primer 99-3337 for SEQ 3329, in complement
accaaaggagtagagcagcag

SEQ ID NO: 11195 - DNA, 18 bp, Homo Sapiens
  primer_bind 1..18: downstream amplification primer 99-3342 for SEQ 3330, in complement
attctcacgacccgaaac

SEQ ID NO: 11196 - DNA, 18 bp, Homo Sapiens
  primer_bind 1..18: downstream amplification primer 99-3347 for SEQ 3331, in complement
gacacactgtctgtattg

SEQ ID NO: 11197 - DNA, 21 bp, Homo Sapiens
  primer_bind 1..21: downstream amplification primer 99-3349 for SEQ 3332, in complement
aaaatgctcctctgctccctg

SEQ ID NO: 11198 - DNA, 18 bp, Homo Sapiens
  primer_bind 1..18: downstream amplification primer 99-3353 for SEQ 3333, in complement
cccaaaaattacccaccc

SEQ ID NO: 11199 - DNA, 21 bp, Homo Sapiens
  primer_bind 1..21: downstream amplification primer 99-3356 for SEQ 3334, in complement
aaagtttgctgaaacccagac

SEQ ID NO: 11200 - DNA, 18 bp, Homo Sapiens
  primer_bind 1..18: downstream amplification primer 99-3368 for SEQ 3335, in complement
gactttgaatggaatggg

SEQ ID NO: 11201 - DNA, 20 bp, Homo Sapiens
  primer_bind 1..20: downstream amplification primer 99-3373 for SEQ 3336, in complement
ctgttagttttaaactggtg

SEQ ID NO: 11202 - DNA, 19 bp, Homo Sapiens
  primer_bind 1..19: downstream amplification primer 99-3374 for SEQ 3337, in complement
ctattgatactttctgagg

SEQ ID NO: 11203 - DNA, 18 bp, Homo Sapiens
  primer_bind 1..18: downstream amplification primer 99-3385 for SEQ 3338, in complement
acagaaaaggggtgtgtg

SEQ ID NO: 11204 - DNA, 20 bp, Homo Sapiens
  primer_bind 1..20: downstream amplification primer 99-3390 for SEQ 3339, in complement
cggaatgctaagaaggaagg

SEQ ID NO: 11205 - DNA, 21 bp, Homo Sapiens
  primer_bind 1..21: downstream amplification primer 99-3391 for SEQ 3340, in complement
tggagttgttgtttttaagag

SEQ ID NO: 11206 - DNA, 21 bp, Homo Sapiens
  primer_bind 1..21: downstream amplification primer 99-3393 for SEQ 3341, in complement
aactggaggaagcagagaagg

SEQ ID NO: 11207 - DNA, 20 bp, Homo Sapiens
  primer_bind 1..20: downstream amplification primer 99-3398 for SEQ 3342, in complement
catgtctgctgacagagagg

SEQ ID NO: 11208 - DNA, 19 bp, Homo Sapiens
  primer_bind 1..19: downstream amplification primer 99-3399 for SEQ 3343, in complement
tccttccacccatacagag

SEQ ID NO: 11209 - DNA, 20 bp, Homo Sapiens
  primer_bind 1..20: downstream amplification primer 99-3400 for SEQ 3344, in complement
tctgaaaggaggggacttgg

SEQ ID NO: 11210 - DNA, 18 bp, Homo Sapiens
  primer_bind 1..18: downstream amplification primer 99-3414 for SEQ 3345, in complement
agggtaaaggtctggttc

SEQ ID NO: 11211 - DNA, 18 bp, Homo Sapiens
  primer_bind 1..18: downstream amplification primer 99-3415 for SEQ 3346, in complement
aagcctgcattcttgacc

SEQ ID NO: 11212 - DNA, 20 bp, Homo Sapiens
  primer_bind 1..20: downstream amplification primer 99-3426 for SEQ 3347, in complement
ttcattagtcttactaaggg

SEQ ID NO: 11213 - DNA, 20 bp, Homo Sapiens
  primer_bind 1..20: downstream amplification primer 99-3428 for SEQ 3348, in complement
agaatgccctcctcctcttg

SEQ ID NO: 11214 - DNA, 18 bp, Homo Sapiens
  primer_bind 1..18: downstream amplification primer 99-3445 for SEQ 3349, in complement
gggaaggaatgaactgac

SEQ ID NO: 11215 - DNA, 21 bp, Homo Sapiens
  primer_bind 1..21: downstream amplification primer 99-3453 for SEQ 3350, in complement
taacaaacacagcagcaaacc

SEQ ID NO: 11216 - DNA, 21 bp, Homo Sapiens
  primer_bind 1..21: downstream amplification primer 99-3460 for SEQ 3351, in complement
tccctcaagggtaaccaactc

SEQ ID NO: 11217 - DNA, 18 bp, Homo Sapiens
  primer_bind 1..18: downstream amplification primer 99-3462 for SEQ 3352, in complement
cgggtaagcctacttatg

SEQ ID NO: 11218 - DNA, 20 bp, Homo Sapiens
  primer_bind 1..20: downstream amplification primer 99-3468 for SEQ 3353, in complement
gtcatttagaaaggataccc

SEQ ID NO: 11219 - DNA, 21 bp, Homo Sapiens
  primer_bind 1..21: downstream amplification primer 99-3469 for SEQ 3354, in complement
atgggctggtactttattctg

SEQ ID NO: 11220 - DNA, 18 bp, Homo Sapiens
  primer_bind 1..18: downstream amplification primer 99-3473 for SEQ 3355, in complement
aggggaacagagaaaaag

SEQ ID NO: 11221 - DNA, 21 bp, Homo Sapiens
  primer_bind 1..21: downstream amplification primer 99-3474 for SEQ 3356, in complement
ccatagatgaagggtaagcag

SEQ ID NO: 11222 - DNA, 21 bp, Homo Sapiens
  primer_bind 1..21: downstream amplification primer 99-3478 for SEQ 3357, in complement
gaggaaaatggagacatggag

SEQ ID NO: 11223 - DNA, 18 bp, Homo Sapiens
  primer_bind 1..18: downstream amplification primer 99-3479 for SEQ 3358, in complement
caaagagatggagatagg

SEQ ID NO: 11224 - DNA, 21 bp, Homo Sapiens
  primer_bind 1..21: downstream amplification primer 99-3482 for SEQ 3359, in complement
gcagtaagttttaaatgcccc

SEQ ID NO: 11225 - DNA, 21 bp, Homo Sapiens
  primer_bind 1..21: downstream amplification primer 99-3483 for SEQ 3360, in complement
tgtccccaggatcaatccaag

SEQ ID NO: 11226 - DNA, 18 bp, Homo Sapiens
  primer_bind 1..18: downstream amplification primer 99-3485 for SEQ 3361, in complement
gaatccacagatacagag

SEQ ID NO: 11227 - DNA, 21 bp, Homo Sapiens
  primer_bind 1..21: downstream amplification primer 99-3511 for SEQ 3362, in complement
acatggaggaatcttgcaggg

SEQ ID NO: 11228 - DNA, 21 bp, Homo Sapiens
  primer_bind 1..21: downstream amplification primer 99-3519 for SEQ 3363, in complement
caagcatacaacagaaatcag

SEQ ID NO: 11229 - DNA, 18 bp, Homo Sapiens
  primer_bind 1..18: downstream amplification primer 99-3522 for SEQ 3364, in complement
tcagggttgagaaagttc

SEQ ID NO: 11230 - DNA, 21 bp, Homo Sapiens
  primer_bind 1..21: downstream amplification primer 99-3523 for SEQ 3365, in complement
acatacaacatacttcacatc

SEQ ID NO: 11231 - DNA, 19 bp, Homo Sapiens
  primer_bind 1..19: downstream amplification primer 99-3524 for SEQ 3366, in complement
aacaacaaaagggagatac

SEQ ID NO: 11232 - DNA, 21 bp, Homo Sapiens
  primer_bind 1..21: downstream amplification primer 99-3542 for SEQ 3367, in complement
ctagaatttttctacatccac

SEQ ID NO: 11233 - DNA, 19 bp, Homo Sapiens
  primer_bind 1..19: downstream amplification primer 99-3556 for SEQ 3368, in complement
tttactcaaactcacttcc

SEQ ID NO: 11234 - DNA, 21 bp, Homo Sapiens
  primer_bind 1..21: downstream amplification primer 99-3563 for SEQ 3369, in complement
aacggaaactccagcaaggac

SEQ ID NO: 11235 - DNA, 20 bp, Homo Sapiens
  primer_bind 1..20: downstream amplification primer 99-3580 for SEQ 3370, in complement
aaagagaaattcagtccccc

SEQ ID NO: 11236 - DNA, 21 bp, Homo Sapiens
  primer_bind 1..21: downstream amplification primer 99-3588 for SEQ 3371, in complement
aaagaaaacctttcaaccccc

SEQ ID NO: 11237 - DNA, 21 bp, Homo Sapiens
  primer_bind 1..21: downstream amplification primer 99-3589 for SEQ 3372, in complement
gctgctaagacattacaatgg

SEQ ID NO: 11238 - DNA, 21 bp, Homo Sapiens
  primer_bind 1..21: downstream amplification primer 99-3596 for SEQ 3373, in complement
agaagtgtgtgttgggagaag

SEQ ID NO: 11239 - DNA, 25 bp, Homo Sapiens
  primer_bind 1..25: downstream amplification primer 99-36 for SEQ 3374, in complement
attttacttacttcagttccatgtc

SEQ ID NO: 11240 - DNA, 21 bp, Homo Sapiens
  primer_bind 1..21: downstream amplification primer 99-3601 for SEQ 3375, in complement
ccacatacataccttcttgcc

SEQ ID NO: 11241 - DNA, 21 bp, Homo Sapiens
  primer_bind 1..21: downstream amplification primer 99-3603 for SEQ 3376, in complement
taagaggttgtcaaatgtggg

SEQ ID NO: 11242 - DNA, 21 bp, Homo Sapiens
  primer_bind 1..21: downstream amplification primer 99-3604 for SEQ 3377, in complement
tcaaaaaacttccctaatctc

SEQ ID NO: 11243 - DNA, 19 bp, Homo Sapiens
  primer_bind 1..19: downstream amplification primer 99-3619 for SEQ 3378, in complement
gtgttggctctttactctg

SEQ ID NO: 11244 - DNA, 18 bp, Homo Sapiens
  primer_bind 1..18: downstream amplification primer 99-3620 for SEQ 3379, in complement
gagctttctctcatccag

SEQ ID NO: 11245 - DNA, 21 bp, Homo Sapiens
  primer_bind 1..21: downstream amplification primer 99-3628 for SEQ 3380, in complement
acttctcatttctccaaccac

SEQ ID NO: 11246 - DNA, 21 bp, Homo Sapiens
  primer_bind 1..21: downstream amplification primer 99-3629 for SEQ 3381, in complement
ctctgctctccacattccatc

SEQ ID NO: 11247 - DNA, 19 bp, Homo Sapiens
  primer_bind 1..19: downstream amplification primer 99-3631 for SEQ 3382, in complement
gctttagatgtagcccttg

SEQ ID NO: 11248 - DNA, 19 bp, Homo Sapiens
  primer_bind 1..19: downstream amplification primer 99-3638 for SEQ 3383, in complement
gccacacagaaagttcacc

SEQ ID NO: 11249 - DNA, 18 bp, Homo Sapiens
  primer_bind 1..18: downstream amplification primer 99-3641 for SEQ 3384, in complement
gttgctacctttccatcc

SEQ ID NO: 11250 - DNA, 21 bp, Homo Sapiens
  primer_bind 1..21: downstream amplification primer 99-3666 for SEQ 3385, in complement
agctccagaaaatgaagaggg

SEQ ID NO: 11251 - DNA, 20 bp, Homo Sapiens
  primer_bind 1..20: downstream amplification primer 99-3667 for SEQ 3386, in complement
tgcagaaacacacaccctcc

SEQ ID NO: 11252 - DNA, 21 bp, Homo Sapiens
  primer_bind 1..21: downstream amplification primer 99-3677 for SEQ 3387, in complement
aatttaaaccatgtcccagcc

SEQ ID NO: 11253 - DNA, 18 bp, Homo Sapiens
  primer_bind 1..18: downstream amplification primer 99-3680 for SEQ 3388, in complement
aaaacaaccccaccacac

SEQ ID NO: 11254 - DNA, 21 bp, Homo Sapiens
  primer_bind 1..21: downstream amplification primer 99-3689 for SEQ 3389, in complement
caactgattacctgctgtgcc

SEQ ID NO: 11255 - DNA, 21 bp, Homo Sapiens
  primer_bind 1..21: downstream amplification primer 99-3690 for SEQ 3390, in complement
ccctgtcacttaaagatttcc

SEQ ID NO: 11256 - DNA, 21 bp, Homo Sapiens
  primer_bind 1..21: downstream amplification primer 99-3699 for SEQ 3391, in complement
tgctcaagaaactccagccac

SEQ ID NO: 11257 - DNA, 21 bp, Homo Sapiens
  primer_bind 1..21: downstream amplification primer 99-3702 for SEQ 3392, in complement
gaaagccttctcttgtgaaac

SEQ ID NO: 11258 - DNA, 18 bp, Homo Sapiens
  primer_bind 1..18: downstream amplification primer 99-3703 for SEQ 3393, in complement
ctttctctcctctctttc

SEQ ID NO: 11259 - DNA, 21 bp, Homo Sapiens
  primer_bind 1..21: downstream amplification primer 99-3705 for SEQ 3394, in complement
aagtgatgattcagaaggcag

SEQ ID NO: 11260 - DNA, 21 bp, Homo Sapiens
  primer_bind 1..21: downstream amplification primer 99-3709 for SEQ 3395, in complement
agcgaaataagtttgctcatc

SEQ ID NO: 11261 - DNA, 21 bp, Homo Sapiens
  primer_bind 1..21: downstream amplification primer 99-3717 for SEQ 3396, in complement
gttaatgcttaggaagtgagg

SEQ ID NO: 11262 - DNA, 21 bp, Homo Sapiens
  primer_bind 1..21: downstream amplification primer 99-3728 for SEQ 3397, in complement
tattgagaggcataaggatac

SEQ ID NO: 11263 - DNA, 21 bp, Homo Sapiens
  primer_bind 1..21: downstream amplification primer 99-3739 for SEQ 3398, in complement
ctatctgttcatctctctgcc

SEQ ID NO: 11264 - DNA, 21 bp, Homo Sapiens
  primer_bind 1..21: downstream amplification primer 99-3746 for SEQ 3399, in complement
gctcaggatgtcttttttcgg

SEQ ID NO: 11265 - DNA, 21 bp, Homo Sapiens
  primer_bind 1..21: downstream amplification primer 99-3749 for SEQ 3400, in complement
taaccacctgtgtttataccc

SEQ ID NO: 11266 - DNA, 21 bp, Homo Sapiens
  primer_bind 1..21: downstream amplification primer 99-3752 for SEQ 3401, in complement
aagtcagtgaaaccaagaacc

SEQ ID NO: 11267 - DNA, 21 bp, Homo Sapiens
  primer_bind 1..21: downstream amplification primer 99-3760 for SEQ 3402, in complement
acttaaaagcaggatggtagg

SEQ ID NO: 11268 - DNA, 21 bp, Homo Sapiens
  primer_bind 1..21: downstream amplification primer 99-3761 for SEQ 3403, in complement
gcagttaatcaacaccagtag

SEQ ID NO: 11269 - DNA, 19 bp, Homo Sapiens
  primer_bind 1..19: downstream amplification primer 99-3764 for SEQ 3404, in complement
gggctttctgtcttttatc

SEQ ID NO: 11270 - DNA, 21 bp, Homo Sapiens
  primer_bind 1..21: downstream amplification primer 99-3765 for SEQ 3405, in complement
ttgtttccattttctcttgcc

SEQ ID NO: 11271 - DNA, 20 bp, Homo Sapiens
  primer_bind 1..20: downstream amplification primer 99-377 for SEQ 3406, in complement
atcaatgacaactcaaagcc

SEQ ID NO: 11272 - DNA, 19 bp, Homo Sapiens
  primer_bind 1..19: downstream amplification primer 99-3773 for SEQ 3407, in complement
caatgactttgccttggac

SEQ ID NO: 11273 - DNA, 21 bp, Homo Sapiens
  primer_bind 1..21: downstream amplification primer 99-3774 for SEQ 3408, in complement
tgttcaagcccagtctctttc

SEQ ID NO: 11274 - DNA, 19 bp, Homo Sapiens
  primer_bind 1..19: downstream amplification primer 99-3775 for SEQ 3409, in complement
cctatattacctcattctc

SEQ ID NO: 11275 - DNA, 21 bp, Homo Sapiens
  primer_bind 1..21: downstream amplification primer 99-3778 for SEQ 3410, in complement
gaagcacaataccagagaaag

SEQ ID NO: 11276 - DNA, 19 bp, Homo Sapiens
  primer_bind 1..19: downstream amplification primer 99-3789 for SEQ 3411, in complement
gtgtagaatatgtgaagag

SEQ ID NO: 11277 - DNA, 20 bp, Homo Sapiens
  primer_bind 1..20: downstream amplification primer 99-3792 for SEQ 3412, in complement
gagttagccaaagagttatc

SEQ ID NO: 11278 - DNA, 21 bp, Homo Sapiens
  primer_bind 1..21: downstream amplification primer 99-3802 for SEQ 3413, in complement
ctgcttttaagattctcattc

SEQ ID NO: 11279 - DNA, 21 bp, Homo Sapiens
  primer_bind 1..21: downstream amplification primer 99-3805 for SEQ 3414, in complement
gggaagataaaaagagtttag

SEQ ID NO: 11280 - DNA, 20 bp, Homo Sapiens
  primer_bind 1..20: downstream amplification primer 99-3812 for SEQ 3415, in complement
tgaggcaggaatcagcacag

SEQ ID NO: 11281 - DNA, 21 bp, Homo Sapiens
  primer_bind 1..21: downstream amplification primer 99-3813 for SEQ 3416, in complement
aataaagatttcatccaggag

SEQ ID NO: 11282 - DNA, 20 bp, Homo Sapiens
  primer_bind 1..20: downstream amplification primer 99-3857 for SEQ 3417, in complement
cactctagtcattaagaatc

SEQ ID NO: 11283 - DNA, 21 bp, Homo Sapiens
  primer_bind 1..21: downstream amplification primer 99-3862 for SEQ 3418, in complement
ctcctttttctctgttttccc

SEQ ID NO: 11284 - DNA, 20 bp, Homo Sapiens
  primer_bind 1..20: downstream amplification primer 99-3875 for SEQ 3419, in complement
gcctgtgtctaagctatatg

SEQ ID NO: 11285 - DNA, 21 bp, Homo Sapiens
  primer_bind 1..21: downstream amplification primer 99-3888 for SEQ 3420, in complement
taccatctcttcggcattctc

SEQ ID NO: 11286 - DNA, 19 bp, Homo Sapiens
  primer_bind 1..19: downstream amplification primer 99-3893 for SEQ 3421, in complement
ggcttgtgcttttactttc

SEQ ID NO: 11287 - DNA, 18 bp, Homo Sapiens
  primer_bind 1..18: downstream amplification primer 99-3941 for SEQ 3422, in complement
taagcccactcccttaac

SEQ ID NO: 11288 - DNA, 21 bp, Homo Sapiens
  primer_bind 1..21: downstream amplification primer 99-3944 for SEQ 3423, in complement
ttctaccctcaactgatcttc

SEQ ID NO: 11289 - DNA, 21 bp, Homo Sapiens
  primer_bind 1..21: downstream amplification primer 99-3953 for SEQ 3424, in complement
cattttactagacgaggagac

SEQ ID NO: 11290 - DNA, 18 bp, Homo Sapiens
  primer_bind 1..18: downstream amplification primer 99-3954 for SEQ 3425, in complement
tcgctccacctatattac

SEQ ID NO: 11291 - DNA, 20 bp, Homo Sapiens
  primer_bind 1..20: downstream amplification primer 99-3978 for SEQ 3426, in complement
ccccaaagcatcatcagcac

SEQ ID NO: 11292 - DNA, 18 bp, Homo Sapiens
  primer_bind 1..18: downstream amplification primer 99-3981 for SEQ 3427, in complement
gcatttagcaagcactcc

SEQ ID NO: 11293 - DNA, 18 bp, Homo Sapiens
  primer_bind 1..18: downstream amplification primer 99-3992 for SEQ 3428, in complement
tgcctctcctcattgaac

SEQ ID NO: 11294 - DNA, 20 bp, Homo Sapiens
  primer_bind 1..20: downstream amplification primer 99-4001 for SEQ 3429, in complement
gcctctcaactgacttttag

SEQ ID NO: 11295 - DNA, 18 bp, Homo Sapiens
  primer_bind 1..18: downstream amplification primer 99-4009 for SEQ 3430, in complement
agttggtgatgaagtgag

SEQ ID NO: 11296 - DNA, 18 bp, Homo Sapiens
  primer_bind 1..18: downstream amplification primer 99-4025 for SEQ 3431, in complement
ctggagaagaaaaggtgc

SEQ ID NO: 11297 - DNA, 18 bp, Homo Sapiens
  primer_bind 1..18: downstream amplification primer 99-4052 for SEQ 3432, in complement
ttgaggggaaaaagagag

SEQ ID NO: 11298 - DNA, 19 bp, Homo Sapiens
  primer_bind 1..19: downstream amplification primer 99-4064 for SEQ 3433, in complement
tataggaggtaagaggtgg

SEQ ID NO: 11299 - DNA, 21 bp, Homo Sapiens
  primer_bind 1..21: downstream amplification primer 99-4065 for SEQ 3434, in complement
ccatcccatctattataaacc

SEQ ID NO: 11300 - DNA, 19 bp, Homo Sapiens
  primer_bind 1..19: downstream amplification primer 99-4073 for SEQ 3435, in complement
tccctcatccaaaacactc

SEQ ID NO: 11301 - DNA, 19 bp, Homo Sapiens
  primer_bind 1..19: downstream amplification primer 99-4076 for SEQ 3436, in complement
tacccttgtgccagtagtg

SEQ ID NO: 11302 - DNA, 19 bp, Homo Sapiens
  primer_bind 1..19: downstream amplification primer 99-4077 for SEQ 3437, in complement
aaaggaggaagagcagagg

SEQ ID NO: 11303 - DNA, 18 bp, Homo Sapiens
  primer_bind 1..18: downstream amplification primer 99-4078 for SEQ 3438, in complement
tccctacccagaacaatg

SEQ ID NO: 11304 - DNA, 18 bp, Homo Sapiens
  primer_bind 1..18: downstream amplification primer 99-4079 for SEQ 3439, in complement
gttaccgttaccgtcttg

SEQ ID NO: 11305 - DNA, 20 bp, Homo Sapiens
  primer_bind 1..20: downstream amplification primer 99-4119 for SEQ 3440, in complement
agcccctatttttttttctg

SEQ ID NO: 11306 - DNA, 18 bp, Homo Sapiens
  primer_bind 1..18: downstream amplification primer 99-4120 for SEQ 3441, in complement
cacaggttgagaacatgg

SEQ ID NO: 11307 - DNA, 21 bp, Homo Sapiens
  primer_bind 1..21: downstream amplification primer 99-4122 for SEQ 3442, in complement
catttacgctactactttttc

SEQ ID NO: 11308 - DNA, 20 bp, Homo Sapiens
  primer_bind 1..20: downstream amplification primer 99-4125 for SEQ 3443, in complement
caactgtctttcatgtcccc

SEQ ID NO: 11309 - DNA, 21 bp, Homo Sapiens
  primer_bind 1..21: downstream amplification primer 99-4131 for SEQ 3444, in complement
actatatggtttagacaggag

SEQ ID NO: 11310 - DNA, 21 bp, Homo Sapiens
  primer_bind 1..21: downstream amplification primer 99-4138 for SEQ 3445, in complement
ttcagccattacccccaatac

SEQ ID NO: 11311 - DNA, 18 bp, Homo Sapiens
  primer_bind 1..18: downstream amplification primer 99-4139 for SEQ 3446, in complement
agtttaggaagtaggggg

SEQ ID NO: 11312 - DNA, 21 bp, Homo Sapiens
  primer_bind 1..21: downstream amplification primer 99-4140 for SEQ 3447, in complement
tctctgaccgtgcttttattg

SEQ ID NO: 11313 - DNA, 21 bp, Homo Sapiens
  primer_bind 1..21: downstream amplification primer 99-4182 for SEQ 3448, in complement
gcattgttttaatctcatagg

SEQ ID NO: 11314 - DNA, 18 bp, Homo Sapiens
  primer_bind 1..18: downstream amplification primer 99-4193 for SEQ 3449, in complement
atgggctgaaggagaatg

SEQ ID NO: 11315 - DNA, 21 bp, Homo Sapiens
  primer_bind 1..21: downstream amplification primer 99-4194 for SEQ 3450, in complement
atgattagtcacatccctcac

SEQ ID NO: 11316 - DNA, 19 bp, Homo Sapiens
  primer_bind 1..19: downstream amplification primer 99-4199 for SEQ 3451, in complement
gggcttccttccaatttac

SEQ ID NO: 11317 - DNA, 21 bp, Homo Sapiens
  primer_bind 1..21: downstream amplification primer 99-4201 for SEQ 3452, in complement
tttccttctgataatccatcc

SEQ ID NO: 11318 - DNA, 21 bp, Homo Sapiens
  primer_bind 1..21: downstream amplification primer 99-4202 for SEQ 3453, in complement
tggaatactcaatgttgctgg

SEQ ID NO: 11319 - DNA, 19 bp, Homo Sapiens
  primer_bind 1..19: downstream amplification primer 99-4203 for SEQ 3454, in complement
ttcccaatataattctgcc

SEQ ID NO: 11320 - DNA, 20 bp, Homo Sapiens
  primer_bind 1..20: downstream amplification primer 99-4207 for SEQ 3455, in complement
actctccatctcctactccc

SEQ ID NO: 11321 - DNA, 21 bp, Homo Sapiens
  primer_bind 1..21: downstream amplification primer 99-4218 for SEQ 3456, in complement
gcacccattttaagcaatcag

SEQ ID NO: 11322 - DNA, 19 bp, Homo Sapiens
  primer_bind 1..19: downstream amplification primer 99-4220 for SEQ 3457, in complement
gggtggaatgaggaatatg

SEQ ID NO: 11323 - DNA, 21 bp, Homo Sapiens
  primer_bind 1..21: downstream amplification primer 99-4225 for SEQ 3458, in complement
ccaacttcatactttcatctc

SEQ ID NO: 11324 - DNA, 18 bp, Homo Sapiens
  primer_bind 1..18: downstream amplification primer 99-4231 for SEQ 3459, in complement
atctacctgaaactgacc

SEQ ID NO: 11325 - DNA, 21 bp, Homo Sapiens
  primer_bind 1..21: downstream amplification primer 99-4232 for SEQ 3460, in complement
tttaagtctctcacatggagg

SEQ ID NO: 11326 - DNA, 19 bp, Homo Sapiens
  primer_bind 1..19: downstream amplification primer 99-4233 for SEQ 3461, in complement
gtccatttgccttacaatc

SEQ ID NO: 11327 - DNA, 18 bp, Homo Sapiens
  primer_bind 1..18: downstream amplification primer 99-4238 for SEQ 3462, in complement
ccccccatttactcttac

SEQ ID NO: 11328 - DNA, 21 bp, Homo Sapiens
  primer_bind 1..21: downstream amplification primer 99-4251 for SEQ 3463, in complement
ctaaggactagcatcagaatc

SEQ ID NO: 11329 - DNA, 21 bp, Homo Sapiens
  primer_bind 1..21: downstream amplification primer 99-4266 for SEQ 3464, in complement
gagcataaatagtgaagtccc

SEQ ID NO: 11330 - DNA, 21 bp, Homo Sapiens
  primer_bind 1..21: downstream amplification primer 99-4272 for SEQ 3465, in complement
tagtgaccctaatgatccacc

SEQ ID NO: 11331 - DNA, 19 bp, Homo Sapiens
  primer_bind 1..19: downstream amplification primer 99-4283 for SEQ 3466, in complement
aactctcctccctctcaac

SEQ ID NO: 11332 - DNA, 18 bp, Homo Sapiens
  primer_bind 1..18: downstream amplification primer 99-4284 for SEQ 3467, in complement
atgcaaagtagacgtgcc

SEQ ID NO: 11333 - DNA, 21 bp, Homo Sapiens
  primer_bind 1..21: downstream amplification primer 99-4285 for SEQ 3468, in complement
agatgaaggttttatggtggg

SEQ ID NO: 11334 - DNA, 21 bp, Homo Sapiens
  primer_bind 1..21: downstream amplification primer 99-4290 for SEQ 3469, in complement
tgccaaaagtcatcacccaag

SEQ ID NO: 11335 - DNA, 21 bp, Homo Sapiens
  primer_bind 1..21: downstream amplification primer 99-4293 for SEQ 3470, in complement
gtgttcccatcgtctgatttc

SEQ ID NO: 11336 - DNA, 20 bp, Homo Sapiens
  primer_bind 1..20: downstream amplification primer 99-4296 for SEQ 3471, in complement
tggagtagagccagggttag

SEQ ID NO: 11337 - DNA, 21 bp, Homo Sapiens
  primer_bind 1..21: downstream amplification primer 99-4312 for SEQ 3472, in complement
ctgaagagacttgctgtatcc

SEQ ID NO: 11338 - DNA, 19 bp, Homo Sapiens
  primer_bind 1..19: downstream amplification primer 99-4323 for SEQ 3473, in complement
caacatctgttctggaagg

SEQ ID NO: 11339 - DNA, 21 bp, Homo Sapiens
  primer_bind 1..21: downstream amplification primer 99-4325 for SEQ 3474, in complement
aaaaccactttacaagcccac

SEQ ID NO: 11340 - DNA, 18 bp, Homo Sapiens
  primer_bind 1..18: downstream amplification primer 99-4332 for SEQ 3475, in complement
cacaatcagaatgttccc

SEQ ID NO: 11341 - DNA, 21 bp, Homo Sapiens
  primer_bind 1..21: downstream amplification primer 99-4335 for SEQ 3476, in complement
ctgggattttcattttctttg

SEQ ID NO: 11342 - DNA, 21 bp, Homo Sapiens
  primer_bind 1..21: downstream amplification primer 99-4336 for SEQ 3477, in complement
atgctaagccataaaagcctc

SEQ ID NO: 11343 - DNA, 21 bp, Homo Sapiens
  primer_bind 1..21: downstream amplification primer 99-4337 for SEQ 3478, in complement
ccccaacccttttagactgac

SEQ ID NO: 11344 - DNA, 21 bp, Homo Sapiens
  primer_bind 1..21: downstream amplification primer 99-4339 for SEQ 3479, in complement
tgccccacatttctattcatc

SEQ ID NO: 11345 - DNA, 19 bp, Homo Sapiens
  primer_bind 1..19: downstream amplification primer 99-4358 for SEQ 3480, in complement
ctatttcaacagagcaagg

SEQ ID NO: 11346 - DNA, 20 bp, Homo Sapiens
  primer_bind 1..20: downstream amplification primer 99-4364 for SEQ 3481, in complement
gaatacatttggtttcatgg

SEQ ID NO: 11347 - DNA, 21 bp, Homo Sapiens
  primer_bind 1..21: downstream amplification primer 99-4398 for SEQ 3482, in complement
cttcagttatgatttaagagg

SEQ ID NO: 11348 - DNA, 21 bp, Homo Sapiens
  primer_bind 1..21: downstream amplification primer 99-4399 for SEQ 3483, in complement
tttcacttggctctcattctc

SEQ ID NO: 11349 - DNA, 20 bp, Homo Sapiens
  primer_bind 1..20: downstream amplification primer 99-4404 for SEQ 3484, in complement
gatccccaagcccatgtttg

SEQ ID NO: 11350 - DNA, 18 bp, Homo Sapiens
  primer_bind 1..18: downstream amplification primer 99-4406 for SEQ 3485, in complement
gtgataatgagagaggtg

SEQ ID NO: 11351 - DNA, 21 bp, Homo Sapiens
  primer_bind 1..21: downstream amplification primer 99-4435 for SEQ 3486, in complement
gtttctcctgtgtgatgtgtg

SEQ ID NO: 11352 - DNA, 18 bp, Homo Sapiens
  primer_bind 1..18: downstream amplification primer 99-4448 for SEQ 3487, in complement
agagatgggggatggagg

SEQ ID NO: 11353 - DNA, 19 bp, Homo Sapiens
  primer_bind 1..19: downstream amplification primer 99-4455 for SEQ 3488, in complement
ctgaatgaggaggaaaaac

SEQ ID NO: 11354 - DNA, 18 bp, Homo Sapiens
  primer_bind 1..18: downstream amplification primer 99-4458 for SEQ 3489, in complement
ccctgtgtccaaaccacc

SEQ ID NO: 11355 - DNA, 20 bp, Homo Sapiens
  primer_bind 1..20: downstream amplification primer 99-4467 for SEQ 3490, in complement
ctgggttcattgtattgttc

SEQ ID NO: 11356 - DNA, 21 bp, Homo Sapiens
  primer_bind 1..21: downstream amplification primer 99-4468 for SEQ 3491, in complement
ccctcttctactaaaaccctg

SEQ ID NO: 11357 - DNA, 18 bp, Homo Sapiens
  primer_bind 1..18: downstream amplification primer 99-4483 for SEQ 3492, in complement
agtagttctggtaggctc

SEQ ID NO: 11358 - DNA, 20 bp, Homo Sapiens
  primer_bind 1..20: downstream amplification primer 99-4534 for SEQ 3493, in complement
gatctgaagttttcagggag

SEQ ID NO: 11359 - DNA, 21 bp, Homo Sapiens
  primer_bind 1..21: downstream amplification primer 99-4567 for SEQ 3494, in complement
agcagggcgttctcattcttc

SEQ ID NO: 11360 - DNA, 19 bp, Homo Sapiens
  primer_bind 1..19: downstream amplification primer 99-4575 for SEQ 3495, in complement
tttagtatgtggtagaagg

SEQ ID NO: 11361 - DNA, 20 bp, Homo Sapiens
  primer_bind 1..20: downstream amplification primer 99-4580 for SEQ 3496, in complement
actgcattctccagtctccc

SEQ ID NO: 11362 - DNA, 18 bp, Homo Sapiens
  primer_bind 1..18: downstream amplification primer 99-4589 for SEQ 3497, in complement
ttactcctagtaggcatc

SEQ ID NO: 11363 - DNA, 18 bp, Homo Sapiens
  primer_bind 1..18: downstream amplification primer 99-4614 for SEQ 3498, in complement
tcctgcacagctcttttg

SEQ ID NO: 11364 - DNA, 20 bp, Homo Sapiens
  primer_bind 1..20: downstream amplification primer 99-4619 for SEQ 3499, in complement
ttgttctcttatcacatctc

SEQ ID NO: 11365 - DNA, 18 bp, Homo Sapiens
  primer_bind 1..18: downstream amplification primer 99-4636 for SEQ 3500, in complement
ggcacttaggaggtattg

SEQ ID NO: 11366 - DNA, 20 bp, Homo Sapiens
  primer_bind 1..20: downstream amplification primer 99-4649 for SEQ 3501, in complement
ccataagaaacgaggttttg

SEQ ID NO: 11367 - DNA, 21 bp, Homo Sapiens
  primer_bind 1..21: downstream amplification primer 99-468 for SEQ 3502, in complement
ataatactatggacctaccac

SEQ ID NO: 11368 - DNA, 21 bp, Homo Sapiens
  primer_bind 1..21: downstream amplification primer 99-4688 for SEQ 3503, in complement
cttctatccatccctcaaccc

SEQ ID NO: 11369 - DNA, 20 bp, Homo Sapiens
  primer_bind 1..20: downstream amplification primer 99-4691 for SEQ 3504, in complement
ctcaagttagtaggcatttg

SEQ ID NO: 11370 - DNA, 20 bp, Homo Sapiens
  primer_bind 1..20: downstream amplification primer 99-4692 for SEQ 3505, in complement
ggaagagtaagaacacatag

SEQ ID NO: 11371 - DNA, 21 bp, Homo Sapiens
  primer_bind 1..21: downstream amplification primer 99-4715 for SEQ 3506, in complement
atcattacacttttctcagtc

SEQ ID NO: 11372 - DNA, 21 bp, Homo Sapiens
  primer_bind 1..21: downstream amplification primer 99-4736 for SEQ 3507, in complement
gtcatttcctctcttggcaac

SEQ ID NO: 11373 - DNA, 21 bp, Homo Sapiens
  primer_bind 1..21: downstream amplification primer 99-4744 for SEQ 3508, in complement
tgatgaatcattccttttcag

SEQ ID NO: 11374 - DNA, 18 bp, Homo Sapiens
  primer_bind 1..18: downstream amplification primer 99-4746 for SEQ 3509, in complement
acaatgttcaccccatac

SEQ ID NO: 11375 - DNA, 20 bp, Homo Sapiens
  primer_bind 1..20: downstream amplification primer 99-4748 for SEQ 3510, in complement
aaattgggaaagaggattgc

SEQ ID NO: 11376 - DNA, 20 bp, Homo Sapiens
  primer_bind 1..20: downstream amplification primer 99-4755 for SEQ 3511, in complement
gagaagtgctaactaaagac

SEQ ID NO: 11377 - DNA, 19 bp, Homo Sapiens
  primer_bind 1..19: downstream amplification primer 99-4758 for SEQ 3512, in complement
tctgctcgggtcagtattc

SEQ ID NO: 11378 - DNA, 18 bp, Homo Sapiens
  primer_bind 1..18: downstream amplification primer 99-4772 for SEQ 3513, in complement
cactggatactttgtcac

SEQ ID NO: 11379 - DNA, 21 bp, Homo Sapiens
  primer_bind 1..21: downstream amplification primer 99-4791 for SEQ 3514, in complement
ataggcacacaggattgaggg

SEQ ID NO: 11380 - DNA, 18 bp, Homo Sapiens
  primer_bind 1..18: downstream amplification primer 99-4792 for SEQ 3515, in complement
ctctctattggtcttctc

SEQ ID NO: 11381 - DNA, 18 bp, Homo Sapiens
  primer_bind 1..18: downstream amplification primer 99-4799 for SEQ 3516, in complement
gactcactgccttgtttg

SEQ ID NO: 11382 - DNA, 21 bp, Homo Sapiens
  primer_bind 1..21: downstream amplification primer 99-480 for SEQ 3517, in complement
ctgtttgaaagaaaatcatgc

SEQ ID NO: 11383 - DNA, 21 bp, Homo Sapiens
  primer_bind 1..21: downstream amplification primer 99-4810 for SEQ 3518, in complement
ggggagaaaaatcacaaaagg

SEQ ID NO: 11384 - DNA, 19 bp, Homo Sapiens
  primer_bind 1..19: downstream amplification primer 99-4825 for SEQ 3519, in complement
gatgaaaagtgttctggag

SEQ ID NO: 11385 - DNA, 21 bp, Homo Sapiens
  primer_bind 1..21: downstream amplification primer 99-4832 for SEQ 3520, in complement
ctttaactgcctttttagaac

SEQ ID NO: 11386 - DNA, 21 bp, Homo Sapiens
  primer_bind 1..21: downstream amplification primer 99-4837 for SEQ 3521, in complement
tacaacagacacagctatacc

SEQ ID NO: 11387 - DNA, 21 bp, Homo Sapiens
  primer_bind 1..21: downstream amplification primer 99-4856 for SEQ 3522, in complement
gagagtgagatttacctaccc

SEQ ID NO: 11388 - DNA, 20 bp, Homo Sapiens
  primer_bind 1..20: downstream amplification primer 99-4871 for SEQ 3523, in complement
gggatataaagacatgcaac

SEQ ID NO: 11389 - DNA, 18 bp, Homo Sapiens
  primer_bind 1..18: downstream amplification primer 99-4874 for SEQ 3524, in complement
atatcttcaaccctggag

SEQ ID NO: 11390 - DNA, 18 bp, Homo Sapiens
  primer_bind 1..18: downstream amplification primer 99-4885 for SEQ 3525, in complement
cacaagttgcttagcttc

SEQ ID NO: 11391 - DNA, 18 bp, Homo Sapiens
  primer_bind 1..18: downstream amplification primer 99-49 for SEQ 3526, in complement
tcaggaggttgattacag

SEQ ID NO: 11392 - DNA, 21 bp, Homo Sapiens
  primer_bind 1..21: downstream amplification primer 99-4903 for SEQ 3527, in complement
gctctaaaatatgctctatcc

SEQ ID NO: 11393 - DNA, 21 bp, Homo Sapiens
  primer_bind 1..21: downstream amplification primer 99-499 for SEQ 3528, in complement
cagaataaatgatttgagacc

SEQ ID NO: 11394 - DNA, 18 bp, Homo Sapiens
  primer_bind 1..18: downstream amplification primer 99-5059 for SEQ 3529, in complement
gagcagagggagaccaag

SEQ ID NO: 11395 - DNA, 19 bp, Homo Sapiens
  primer_bind 1..19: downstream amplification primer 99-5074 for SEQ 3530, in complement
agaacacaagtgcccacag

SEQ ID NO: 11396 - DNA, 20 bp, Homo Sapiens
  primer_bind 1..20: downstream amplification primer 99-5076 for SEQ 3531, in complement
aggaatcaaggactggagag

SEQ ID NO: 11397 - DNA, 19 bp, Homo Sapiens
  primer_bind 1..19: downstream amplification primer 99-5098 for SEQ 3532, in complement
tggcaacgatagacactgg

SEQ ID NO: 11398 - DNA, 18 bp, Homo Sapiens
  primer_bind 1..18: downstream amplification primer 99-51 for SEQ 3533, in complement
cagcctctaagacttacc

SEQ ID NO: 11399 - DNA, 19 bp, Homo Sapiens
  primer_bind 1..19: downstream amplification primer 99-5112 for SEQ 3534, in complement
gtatatgattccttcaccc

SEQ ID NO: 11400 - DNA, 21 bp, Homo Sapiens
  primer_bind 1..21: downstream amplification primer 99-515 for SEQ 3535, in complement
atattgtgggaatcactgtgg

SEQ ID NO: 11401 - DNA, 21 bp, Homo Sapiens
  primer_bind 1..21: downstream amplification primer 99-5166 for SEQ 3536, in complement
cacataacactggatactgac

SEQ ID NO: 11402 - DNA, 20 bp, Homo Sapiens
  primer_bind 1..20: downstream amplification primer 99-5167 for SEQ 3537, in complement
tttaccattagaacccagag

SEQ ID NO: 11403 - DNA, 18 bp, Homo Sapiens
  primer_bind 1..18: downstream amplification primer 99-5176 for SEQ 3538, in complement
gtagagcacagtcaaaac

SEQ ID NO: 11404 - DNA, 21 bp, Homo Sapiens
  primer_bind 1..21: downstream amplification primer 99-5240 for SEQ 3539, in complement
tttccaaaactcatcaacccc

SEQ ID NO: 11405 - DNA, 19 bp, Homo Sapiens
  primer_bind 1..19: downstream amplification primer 99-5329 for SEQ 3540, in complement
gccaacttagctccttgtc

SEQ ID NO: 11406 - DNA, 18 bp, Homo Sapiens
  primer_bind 1..18: downstream amplification primer 99-5339 for SEQ 3541, in complement
gaatcctgcttcattgcc

SEQ ID NO: 11407 - DNA, 18 bp, Homo Sapiens
  primer_bind 1..18: downstream amplification primer 99-5347 for SEQ 3542, in complement
aggtgagagttgaagagg

SEQ ID NO: 11408 - DNA, 21 bp, Homo Sapiens
  primer_bind 1..21: downstream amplification primer 99-5397 for SEQ 3543, in complement
gtaagagagatagggatgtgg

SEQ ID NO: 11409 - DNA, 19 bp, Homo Sapiens
  primer_bind 1..19: downstream amplification primer 99-55 for SEQ 3544, in complement
actcaggctgggttttagg

SEQ ID NO: 11410 - DNA, 19 bp, Homo Sapiens
  primer_bind 1..19: downstream amplification primer 99-5549 for SEQ 3545, in complement
cattggtattgagactcgg

SEQ ID NO: 11411 - DNA, 21 bp, Homo Sapiens
  primer_bind 1..21: downstream amplification primer 99-5569 for SEQ 3546, in complement
cccttaactttaccccttacc

SEQ ID NO: 11412 - DNA, 21 bp, Homo Sapiens
  primer_bind 1..21: downstream amplification primer 99-5575 for SEQ 3547, in complement
ttaagagagaatagactttgg

SEQ ID NO: 11413 - DNA, 21 bp, Homo Sapiens
  primer_bind 1..21: downstream amplification primer 99-5602 for SEQ 3548, in complement
aataatcctctcctctcagtc

SEQ ID NO: 11414 - DNA, 21 bp, Homo Sapiens
  primer_bind 1..21: downstream amplification primer 99-5671 for SEQ 3549, in complement
agagagacactaaaacgagac

SEQ ID NO: 11415 - DNA, 21 bp, Homo Sapiens
  primer_bind 1..21: downstream amplification primer 99-568 for SEQ 3550, in complement
tatctcattttcccaaacacc

SEQ ID NO: 11416 - DNA, 20 bp, Homo Sapiens
  primer_bind 1..20: downstream amplification primer 99-5688 for SEQ 3551, in complement
ggggacacgcaacttaaagg

SEQ ID NO: 11417 - DNA, 21 bp, Homo Sapiens
  primer_bind 1..21: downstream amplification primer 99-5689 for SEQ 3552, in complement
aaattggttcttcctttcatc

SEQ ID NO: 11418 - DNA, 20 bp, Homo Sapiens
  primer_bind 1..20: downstream amplification primer 99-5715 for SEQ 3553, in complement
cctctgcatgaggatttgcg

SEQ ID NO: 11419 - DNA, 20 bp, Homo Sapiens
  primer_bind 1..20: downstream amplification primer 99-5718 for SEQ 3554, in complement
cacatgcttcttagagacag

SEQ ID NO: 11420 - DNA, 20 bp, Homo Sapiens
  primer_bind 1..20: downstream amplification primer 99-5723 for SEQ 3555, in complement
ctgctgagttggaagaatac

SEQ ID NO: 11421 - DNA, 21 bp, Homo Sapiens
  primer_bind 1..21: downstream amplification primer 99-5747 for SEQ 3556, in complement
gggtcacacagcaagtcaatg

SEQ ID NO: 11422 - DNA, 21 bp, Homo Sapiens
  primer_bind 1..21: downstream amplification primer 99-5775 for SEQ 3557, in complement
ttcaaatggcaagaacaatgg

SEQ ID NO: 11423 - DNA, 19 bp, Homo Sapiens
  primer_bind 1..19: downstream amplification primer 99-5828 for SEQ 3558, in complement
agaacaggggtcagagaag

SEQ ID NO: 11424 - DNA, 19 bp, Homo Sapiens
  primer_bind 1..19: downstream amplification primer 99-5846 for SEQ 3559, in complement
gcagcacagcagttttctc

SEQ ID NO: 11425 - DNA, 20 bp, Homo Sapiens
  primer_bind 1..20: downstream amplification primer 99-5861 for SEQ 3560, in complement
ccaccctataactcacccac

SEQ ID NO: 11426 - DNA, 18 bp, Homo Sapiens
  primer_bind 1..18: downstream amplification primer 99-59 for SEQ 3561, in complement
ctttaatcactgactccg

SEQ ID NO: 11427 - DNA, 21 bp, Homo Sapiens
  primer_bind 1..21: downstream amplification primer 99-5930 for SEQ 3562, in complement
gcaaaagggtgtcctctgatg

SEQ ID NO: 11428 - DNA, 21 bp, Homo Sapiens
  primer_bind 1..21: downstream amplification primer 99-5931 for SEQ 3563, in complement
attatgccttttttttctccc

SEQ ID NO: 11429 - DNA, 21 bp, Homo Sapiens
  primer_bind 1..21: downstream amplification primer 99-5967 for SEQ 3564, in complement
ttgtgcttcttcatcagtgtc

SEQ ID NO: 11430 - DNA, 18 bp, Homo Sapiens
  primer_bind 1..18: downstream amplification primer 99-5987 for SEQ 3565, in complement
catctttggatgccacac

SEQ ID NO: 11431 - DNA, 21 bp, Homo Sapiens
  primer_bind 1..21: downstream amplification primer 99-5996 for SEQ 3566, in complement
tttaaccattttgcttgtgcc

SEQ ID NO: 11432 - DNA, 20 bp, Homo Sapiens
  primer_bind 1..20: downstream amplification primer 99-6001 for SEQ 3567, in complement
gacagtatatgaggcaatgg

SEQ ID NO: 11433 - DNA, 18 bp, Homo Sapiens
  primer_bind 1..18: downstream amplification primer 99-6020 for SEQ 3568, in complement
cctccaatctcttgtatc

SEQ ID NO: 11434 - DNA, 20 bp, Homo Sapiens
  primer_bind 1..20: downstream amplification primer 99-6047 for SEQ 3569, in complement
ttcctcttctccgcaacctc

SEQ ID NO: 11435 - DNA, 18 bp, Homo Sapiens
  primer_bind 1..18: downstream amplification primer 99-6071 for SEQ 3570, in complement
aaggtaggagtttctggg

SEQ ID NO: 11436 - DNA, 18 bp, Homo Sapiens
  primer_bind 1..18: downstream amplification primer 99-6076 for SEQ 3571, in complement
cttcattctcagagtgcc

SEQ ID NO: 11437 - DNA, 21 bp, Homo Sapiens
  primer_bind 1..21: downstream amplification primer 99-6096 for SEQ 3572, in complement
agctcaagacttcccagatac

SEQ ID NO: 11438 - DNA, 18 bp, Homo Sapiens
  primer_bind 1..18: downstream amplification primer 99-6103 for SEQ 3573, in complement
ttcctgagcagactttag

SEQ ID NO: 11439 - DNA, 21 bp, Homo Sapiens
  primer_bind 1..21: downstream amplification primer 99-6124 for SEQ 3574, in complement
acagaagtaaaacataactgg

SEQ ID NO: 11440 - DNA, 18 bp, Homo Sapiens
  primer_bind 1..18: downstream amplification primer 99-6173 for SEQ 3575, in complement
agacccacagagtctaac

SEQ ID NO: 11441 - DNA, 19 bp, Homo Sapiens
  primer_bind 1..19: downstream amplification primer 99-634 for SEQ 3576, in complement
tagcctaatggtgaccgtg

SEQ ID NO: 11442 - DNA, 20 bp, Homo Sapiens
  primer_bind 1..20: downstream amplification primer 99-6401 for SEQ 3577, in complement
gagacactaatcctttcctg

SEQ ID NO: 11443 - DNA, 20 bp, Homo Sapiens
  primer_bind 1..20: downstream amplification primer 99-6538 for SEQ 3578, in complement
ttctgaggctattgtctatc

SEQ ID NO: 11444 - DNA, 18 bp, Homo Sapiens
  primer_bind 1..18: downstream amplification primer 99-6549 for SEQ 3579, in complement
attttctcccaaggtgac

SEQ ID NO: 11445 - DNA, 18 bp, Homo Sapiens
  primer_bind 1..18: downstream amplification primer 99-6564 for SEQ 3580, in complement
caggttgaagacacacag

SEQ ID NO: 11446 - DNA, 19 bp, Homo Sapiens
  primer_bind 1..19: downstream amplification primer 99-6574 for SEQ 3581, in complement
gaagaattgagaagagaag

SEQ ID NO: 11447 - DNA, 20 bp, Homo Sapiens
  primer_bind 1..20: downstream amplification primer 99-6583 for SEQ 3582, in complement
cccttctttatttcttgacc

SEQ ID NO: 11448 - DNA, 20 bp, Homo Sapiens
  primer_bind 1..20: downstream amplification primer 99-6591 for SEQ 3583, in complement
tctacccattttcttttcac

SEQ ID NO: 11449 - DNA, 21 bp, Homo Sapiens
  primer_bind 1..21: downstream amplification primer 99-6597 for SEQ 3584, in complement
caataaactgcttcagatgtc

SEQ ID NO: 11450 - DNA, 18 bp, Homo Sapiens
  primer_bind 1..18: downstream amplification primer 99-6603 for SEQ 3585, in complement
aacaccaaagagagacac

SEQ ID NO: 11451 - DNA, 20 bp, Homo Sapiens
  primer_bind 1..20: downstream amplification primer 99-6707 for SEQ 3586, in complement
atgcctgaggatgaggacac

SEQ ID NO: 11452 - DNA, 19 bp, Homo Sapiens
  primer_bind 1..19: downstream amplification primer 99-6720 for SEQ 3587, in complement
caaggcttattatgaacag

SEQ ID NO: 11453 - DNA, 18 bp, Homo Sapiens
  primer_bind 1..18: downstream amplification primer 99-6809 for SEQ 3588, in complement
caagaactccacacatac

SEQ ID NO: 11454 - DNA, 20 bp, Homo Sapiens
  primer_bind 1..20: downstream amplification primer 99-6834 for SEQ 3589, in complement
taataaactggaagcctctg

SEQ ID NO: 11455 - DNA, 19 bp, Homo Sapiens
  primer_bind 1..19: downstream amplification primer 99-6837 for SEQ 3590, in complement
ctttacaatgctgcctaac

SEQ ID NO: 11456 - DNA, 21 bp, Homo Sapiens
  primer_bind 1..21: downstream amplification primer 99-6878 for SEQ 3591, in complement
tcttgattcatttgacatctc

SEQ ID NO: 11457 - DNA, 21 bp, Homo Sapiens
  primer_bind 1..21: downstream amplification primer 99-6888 for SEQ 3592, in complement
tcgctccaaattaaactgctc

SEQ ID NO: 11458 - DNA, 21 bp, Homo Sapiens
  primer_bind 1..21: downstream amplification primer 99-6919 for SEQ 3593, in complement
agacaatctttagccgagtcc

SEQ ID NO: 11459 - DNA, 19 bp, Homo Sapiens
  primer_bind 1..19: downstream amplification primer 99-6922 for SEQ 3594, in complement
agagaaactaaatcacagg

SEQ ID NO: 11460 - DNA, 19 bp, Homo Sapiens
  primer_bind 1..19: downstream amplification primer 99-6974 for SEQ 3595, in complement
tcttctgcttcttggtatc

SEQ ID NO: 11461 - DNA, 20 bp, Homo Sapiens
  primer_bind 1..20: downstream amplification primer 99-6978 for SEQ 3596, in complement
caccatgagcattaaatgag

SEQ ID NO: 11462 - DNA, 20 bp, Homo Sapiens
  primer_bind 1..20: downstream amplification primer 99-6984 for SEQ 3597, in complement
aattatgaggagtgagactg

SEQ ID NO: 11463 - DNA, 19 bp, Homo Sapiens
  primer_bind 1..19: downstream amplification primer 99-6998 for SEQ 3598, in complement
tcagacaacatttaggaag

SEQ ID NO: 11464 - DNA, 20 bp, Homo Sapiens
  primer_bind 1..20: downstream amplification primer 99-7032 for SEQ 3599, in complement
gtggaatgaatggatagatg

SEQ ID NO: 11465 - DNA, 20 bp, Homo Sapiens
  primer_bind 1..20: downstream amplification primer 99-7048 for SEQ 3600, in complement
ctcagaaaaagaaaatgtcc

SEQ ID NO: 11466 - DNA, 18 bp, Homo Sapiens
  primer_bind 1..18: downstream amplification primer 99-7060 for SEQ 3601, in complement
catagagtatccagtgcc

SEQ ID NO: 11467 - DNA, 18 bp, Homo Sapiens
  primer_bind 1..18: downstream amplification primer 99-7086 for SEQ 3602, in complement
aatgaccaaacaccaagg

SEQ ID NO: 11468 - DNA, 19 bp, Homo Sapiens
  primer_bind 1..19: downstream amplification primer 99-7117 for SEQ 3603, in complement
gatcattttccttcacacg

SEQ ID NO: 11469 - DNA, 21 bp, Homo Sapiens
  primer_bind 1..21: downstream amplification primer 99-7203 for SEQ 3604, in complement
gggaatgagaaaaaatggtgg

SEQ ID NO: 11470 - DNA, 20 bp, Homo Sapiens
  primer_bind 1..20: downstream amplification primer 99-7268 for SEQ 3605, in complement
actccaccctctaacccttc

SEQ ID NO: 11471 - DNA, 19 bp, Homo Sapiens
  primer_bind 1..19: downstream amplification primer 99-7281 for SEQ 3606, in complement
tggtggtgtgagaggttag

SEQ ID NO: 11472 - DNA, 18 bp, Homo Sapiens
  primer_bind 1..18: downstream amplification primer 99-7282 for SEQ 3607, in complement
agaattgagatcacaggg

SEQ ID NO: 11473 - DNA, 20 bp, Homo Sapiens
  primer_bind 1..20: downstream amplification primer 99-7296 for SEQ 3608, in complement
gggtatgagaaaaaagaatg

SEQ ID NO: 11474 - DNA, 21 bp, Homo Sapiens
  primer_bind 1..21: downstream amplification primer 99-7344 for SEQ 3609, in complement
cattttgtgttgctataacag

SEQ ID NO: 11475 - DNA, 21 bp, Homo Sapiens
  primer_bind 1..21: downstream amplification primer 99-7377 for SEQ 3610, in complement
agttaaatcactgccttttcc

SEQ ID NO: 11476 - DNA, 21 bp, Homo Sapiens
  primer_bind 1..21: downstream amplification primer 99-7394 for SEQ 3611, in complement
aaggcaacccatctatgtatc

SEQ ID NO: 11477 - DNA, 21 bp, Homo Sapiens
  primer_bind 1..21: downstream amplification primer 99-7412 for SEQ 3612, in complement
acagacaacagaacaaagagg

SEQ ID NO: 11478 - DNA, 18 bp, Homo Sapiens
  primer_bind 1..18: downstream amplification primer 99-7422 for SEQ 3613, in complement
acccccatcccatttatc

SEQ ID NO: 11479 - DNA, 21 bp, Homo Sapiens
  primer_bind 1..21: downstream amplification primer 99-7430 for SEQ 3614, in complement
aggtgtaaaatagagaaggtg

SEQ ID NO: 11480 - DNA, 21 bp, Homo Sapiens
  primer_bind 1..21: downstream amplification primer 99-7442 for SEQ 3615, in complement
tctattcattctccctccttc

SEQ ID NO: 11481 - DNA, 21 bp, Homo Sapiens
  primer_bind 1..21: downstream amplification primer 99-7481 for SEQ 3616, in complement
tatcctccttgagacattcag

SEQ ID NO: 11482 - DNA, 18 bp, Homo Sapiens
  primer_bind 1..18: downstream amplification primer 99-7696 for SEQ 3617, in complement
gatggacatctacacttc

SEQ ID NO: 11483 - DNA, 18 bp, Homo Sapiens
  primer_bind 1..18: downstream amplification primer 99-7702 for SEQ 3618, in complement
cccaatttccacccaaag

SEQ ID NO: 11484 - DNA, 21 bp, Homo Sapiens
  primer_bind 1..21: downstream amplification primer 99-7772 for SEQ 3619, in complement
atgaatcaatatagttacccc

SEQ ID NO: 11485 - DNA, 18 bp, Homo Sapiens
  primer_bind 1..18: downstream amplification primer 99-7815 for SEQ 3620, in complement
gtagtcgctgttagattg

SEQ ID NO: 11486 - DNA, 19 bp, Homo Sapiens
  primer_bind 1..19: downstream amplification primer 99-7818 for SEQ 3621, in complement
ccaagccacttatctattc

SEQ ID NO: 11487 - DNA, 18 bp, Homo Sapiens
  primer_bind 1..18: downstream amplification primer 99-7860 for SEQ 3622, in complement
acctcccaatgttatctc

SEQ ID NO: 11488 - DNA, 21 bp, Homo Sapiens
  primer_bind 1..21: downstream amplification primer 99-7886 for SEQ 3623, in complement
ttaaccacagctactgcttcc

SEQ ID NO: 11489 - DNA, 18 bp, Homo Sapiens
  primer_bind 1..18: downstream amplification primer 99-7944 for SEQ 3624, in complement
taccctctaatcacttcc

SEQ ID NO: 11490 - DNA, 21 bp, Homo Sapiens
  primer_bind 1..21: downstream amplification primer 99-7945 for SEQ 3625, in complement
cacttgtcaactgattgcttc

SEQ ID NO: 11491 - DNA, 19 bp, Homo Sapiens
  primer_bind 1..19: downstream amplification primer 99-7976 for SEQ 3626, in complement
cctgattttgtccccattg

SEQ ID NO: 11492 - DNA, 21 bp, Homo Sapiens
  primer_bind 1..21: downstream amplification primer 99-8000 for SEQ 3627, in complement
cgagagttactaggcttcctg

SEQ ID NO: 11493 - DNA, 21 bp, Homo Sapiens
  primer_bind 1..21: downstream amplification primer 99-8006 for SEQ 3628, in complement
gacaaatacgactctttggac

SEQ ID NO: 11494 - DNA, 18 bp, Homo Sapiens
  primer_bind 1..18: downstream amplification primer 99-8038 for SEQ 3629, in complement
gcccaagtcacgtaaaag

SEQ ID NO: 11495 - DNA, 19 bp, Homo Sapiens
  primer_bind 1..19: downstream amplification primer 99-8055 for SEQ 3630, in complement
actttgccaggtagtcctc

SEQ ID NO: 11496 - DNA, 18 bp, Homo Sapiens
  primer_bind 1..18: downstream amplification primer 99-8059 for SEQ 3631, in complement
tttgttatctcccagtcc

SEQ ID NO: 11497 - DNA, 20 bp, Homo Sapiens
  primer_bind 1..20: downstream amplification primer 99-8061 for SEQ 3632, in complement
gggaaaacaacaacaacaac

SEQ ID NO: 11498 - DNA, 19 bp, Homo Sapiens
  primer_bind 1..19: downstream amplification primer 99-8109 for SEQ 3633, in complement
gccacagtaaaataccgcc

SEQ ID NO: 11499 - DNA, 21 bp, Homo Sapiens
  primer_bind 1..21: downstream amplification primer 99-8115 for SEQ 3634, in complement
acagatgcagtgttttgtgag

SEQ ID NO: 11500 - DNA, 21 bp, Homo Sapiens
  primer_bind 1..21: downstream amplification primer 99-8166 for SEQ 3635, in complement
agttaaatcactgccttttcc

SEQ ID NO: 11501 - DNA, 18 bp, Homo Sapiens
  primer_bind 1..18: downstream amplification primer 99-8226 for SEQ 3636, in complement
tggataagaaggggagag

SEQ ID NO: 11502 - DNA, 18 bp, Homo Sapiens
  primer_bind 1..18: downstream amplification primer 99-8232 for SEQ 3637, in complement
agcacccacagaaaggag

SEQ ID NO: 11503 - DNA, 19 bp, Homo Sapiens
  primer_bind 1..19: downstream amplification primer 99-824 for SEQ 3638, in complement
tgaatatacagttttcgcc

SEQ ID NO: 11504 - DNA, 19 bp, Homo Sapiens
  primer_bind 1..19: downstream amplification primer 99-8274 for SEQ 3639, in complement
ccctatcattgaaaaagcc

SEQ ID NO: 11505 - DNA, 18 bp, Homo Sapiens
  primer_bind 1..18: downstream amplification primer 99-8359 for SEQ 3640, in complement
ggttggaaagtggtaagg

SEQ ID NO: 11506 - DNA, 18 bp, Homo Sapiens
  primer_bind 1..18: downstream amplification primer 99-8630 for SEQ 3641, in complement
tctctttctgggacattg

SEQ ID NO: 11507 - DNA, 19 bp, Homo Sapiens
  primer_bind 1..19: downstream amplification primer 99-8659 for SEQ 3642, in complement
acttcttttcacaccttac

SEQ ID NO: 11508 - DNA, 20 bp, Homo Sapiens
  primer_bind 1..20: downstream amplification primer 99-8679 for SEQ 3643, in complement
ttctcctcttttttttaccc

SEQ ID NO: 11509 - DNA, 18 bp, Homo Sapiens
  primer_bind 1..18: downstream amplification primer 99-8690 for SEQ 3644, in complement
taacatctcacatcctcc

SEQ ID NO: 11510 - DNA, 18 bp, Homo Sapiens
  primer_bind 1..18: downstream amplification primer 99-8751 for SEQ 3645, in complement
tggatgactaatggggac

SEQ ID NO: 11511 - DNA, 18 bp, Homo Sapiens
  primer_bind 1..18: downstream amplification primer 99-8795 for SEQ 3646, in complement
attcactcccactttcac

SEQ ID NO: 11512 - DNA, 19 bp, Homo Sapiens
  primer_bind 1..19: downstream amplification primer 99-882 for SEQ 3647, in complement
atgatagttttgatggtgg

SEQ ID NO: 11513 - DNA, 21 bp, Homo Sapiens
  primer_bind 1..21: downstream amplification primer 99-887 for SEQ 3648, in complement
taatcaggtattcagccattc

SEQ ID NO: 11514 - DNA, 21 bp, Homo Sapiens
  primer_bind 1..21: downstream amplification primer 99-8875 for SEQ 3649, in complement
atagactataagggctgacgg

SEQ ID NO: 11515 - DNA, 21 bp, Homo Sapiens
  primer_bind 1..21: downstream amplification primer 99-892 for SEQ 3650, in complement
caacagaggagaataagacac

SEQ ID NO: 11516 - DNA, 18 bp, Homo Sapiens
  primer_bind 1..18: downstream amplification primer 99-8936 for SEQ 3651, in complement
ctcctttatcccgttacc

SEQ ID NO: 11517 - DNA, 18 bp, Homo Sapiens
  primer_bind 1..18: downstream amplification primer 99-8952 for SEQ 3652, in complement
ccataaggaattaggtgc

SEQ ID NO: 11518 - DNA, 21 bp, Homo Sapiens
  primer_bind 1..21: downstream amplification primer 99-896 for SEQ 3653, in complement
ggctgtcataaaaaatcactc

SEQ ID NO: 11519 - DNA, 18 bp, Homo Sapiens
  primer_bind 1..18: downstream amplification primer 99-899 for SEQ 3654, in complement
gtcttcttaaaagccctc

SEQ ID NO: 11520 - DNA, 20 bp, Homo Sapiens
  primer_bind 1..20: downstream amplification primer 99-9072 for SEQ 3655, in complement
ctctatgccaactgtctatg

SEQ ID NO: 11521 - DNA, 21 bp, Homo Sapiens
  primer_bind 1..21: downstream amplification primer 99-9076 for SEQ 3656, in complement
agttatgtaagataagggctg

SEQ ID NO: 11522 - DNA, 19 bp, Homo Sapiens
  primer_bind 1..19: downstream amplification primer 99-9077 for SEQ 3657, in complement
tgggtaaaatggaaaaagg

SEQ ID NO: 11523 - DNA, 21 bp, Homo Sapiens
  primer_bind 1..21: downstream amplification primer 99-9089 for SEQ 3658, in complement
agagagagaaaaagagaatag

SEQ ID NO: 11524 - DNA, 21 bp, Homo Sapiens
  primer_bind 1..21: downstream amplification primer 99-9113 for SEQ 3659, in complement
tagaagtaaggataaatgagg

SEQ ID NO: 11525 - DNA, 20 bp, Homo Sapiens
  primer_bind 1..20: downstream amplification primer 99-9145 for SEQ 3660, in complement
caatttaggagacatggaac

SEQ ID NO: 11526 - DNA, 21 bp, Homo Sapiens
  primer_bind 1..21: downstream amplification primer 99-9164 for SEQ 3661, in complement
agttggtgggggggatttaag

SEQ ID NO: 11527 - DNA, 18 bp, Homo Sapiens
  primer_bind 1..18: downstream amplification primer 99-9308 for SEQ 3662, in complement
ccaactacataatccctg

SEQ ID NO: 11528 - DNA, 21 bp, Homo Sapiens
  primer_bind 1..21: downstream amplification primer 99-9316 for SEQ 3663, in complement
atttagacttcctttatgacc

SEQ ID NO: 11529 - DNA, 18 bp, Homo Sapiens
  primer_bind 1..18: downstream amplification primer 99-9343 for SEQ 3664, in complement
cagtaatggaagcaaagg

SEQ ID NO: 11530 - DNA, 18 bp, Homo Sapiens
  primer_bind 1..18: downstream amplification primer 99-9362 for SEQ 3665, in complement
caggttggtttttgcctc

SEQ ID NO: 11531 - DNA, 19 bp, Homo Sapiens
  primer_bind 1..19: downstream amplification primer 99-9363 for SEQ 3666, in complement
taggttttgttgtttggtg

SEQ ID NO: 11532 - DNA, 18 bp, Homo Sapiens
  primer_bind 1..18: downstream amplification primer 99-9375 for SEQ 3667, in complement
gagtgagtccaaagagag

SEQ ID NO: 11533 - DNA, 21 bp, Homo Sapiens
  primer_bind 1..21: downstream amplification primer 99-9380 for SEQ 3668, in complement
atatttgtatgagagtcagag

SEQ ID NO: 11534 - DNA, 21 bp, Homo Sapiens
  primer_bind 1..21: downstream amplification primer 99-9607 for SEQ 3669, in complement
gggactctaagctaaaggtag

SEQ ID NO: 11535 - DNA, 21 bp, Homo Sapiens
  primer_bind 1..21: downstream amplification primer 99-9620 for SEQ 3670, in complement
gaggaggatggagagaatgtg

SEQ ID NO: 11536 - DNA, 21 bp, Homo Sapiens
  primer_bind 1..21: downstream amplification primer 99-9623 for SEQ 3671, in complement
ggattttggggcacactattg

SEQ ID NO: 11537 - DNA, 19 bp, Homo Sapiens
  primer_bind 1..19: downstream amplification primer 99-9633 for SEQ 3672, in complement
ttgagcccacttgagtctg

SEQ ID NO: 11538 - DNA, 20 bp, Homo Sapiens
  primer_bind 1..20: downstream amplification primer 99-9636 for SEQ 3673, in complement
cacaaaaaaggacaaagagg

SEQ ID NO: 11539 - DNA, 21 bp, Homo Sapiens
  primer_bind 1..21: downstream amplification primer 99-9658 for SEQ 3674, in complement
aaggaaagggattgggctctg

SEQ ID NO: 11540 - DNA, 21 bp, Homo Sapiens
  primer_bind 1..21: downstream amplification primer 99-9662 for SEQ 3675, in complement
ggctctgtcaggaaatgaagg

SEQ ID NO: 11541 - DNA, 20 bp, Homo Sapiens
  primer_bind 1..20: downstream amplification primer 99-9666 for SEQ 3676, in complement
tttaatgggtggaatctctc

SEQ ID NO: 11542 - DNA, 21 bp, Homo Sapiens
  primer_bind 1..21: downstream amplification primer 99-9668 for SEQ 3677, in complement
gtcttttttactttggcaggg

SEQ ID NO: 11543 - DNA, 21 bp, Homo Sapiens
  primer_bind 1..21: downstream amplification primer 99-9680 for SEQ 3678, in complement
gatttatgtaacttggatagc

SEQ ID NO: 11544 - DNA, 20 bp, Homo Sapiens
  primer_bind 1..20: downstream amplification primer 99-9696 for SEQ 3679, in complement
gaggtggagtagtttgtgtg

SEQ ID NO: 11545 - DNA, 21 bp, Homo Sapiens
  primer_bind 1..21: downstream amplification primer 99-9697 for SEQ 3680, in complement
taaagtgtagaggtttaggag

SEQ ID NO: 11546 - DNA, 21 bp, Homo Sapiens
  primer_bind 1..21: downstream amplification primer 99-9700 for SEQ 3681, in complement
ctcaaacttaactcacaaaac

SEQ ID NO: 11547 - DNA, 21 bp, Homo Sapiens
  primer_bind 1..21: downstream amplification primer 99-9704 for SEQ 3682, in complement
ttagcaattttcaatgcgttg

SEQ ID NO: 11548 - DNA, 21 bp, Homo Sapiens
  primer_bind 1..21: downstream amplification primer 99-9706 for SEQ 3683, in complement
cagagagcatttgttattgag

SEQ ID NO: 11549 - DNA, 20 bp, Homo Sapiens
  primer_bind 1..20: downstream amplification primer 99-9709 for SEQ 3684, in complement
cctttttagtttttccacac

SEQ ID NO: 11550 - DNA, 21 bp, Homo Sapiens
  primer_bind 1..21: downstream amplification primer 99-9710 for SEQ 3685, in complement
cttcttcccttccttattctg

SEQ ID NO: 11551 - DNA, 21 bp, Homo Sapiens
  primer_bind 1..21: downstream amplification primer 99-9714 for SEQ 3686, in complement
gaaccttagttgttgtgaacc

SEQ ID NO: 11552 - DNA, 21 bp, Homo Sapiens
  primer_bind 1..21: downstream amplification primer 99-9717 for SEQ 3687, in complement
tgtttatttttgagtgggggg

SEQ ID NO: 11553 - DNA, 21 bp, Homo Sapiens
  primer_bind 1..21: downstream amplification primer 99-9726 for SEQ 3688, in complement
tgggttcgtttactgtggctg

SEQ ID NO: 11554 - DNA, 21 bp, Homo Sapiens
  primer_bind 1..21: downstream amplification primer 99-974 for SEQ 3689, in complement
tcataatgactccatataccc

SEQ ID NO: 11555 - DNA, 19 bp, Homo Sapiens
  primer_bind 1..19: downstream amplification primer 99-9745 for SEQ 3690, in complement
agtgattagggtggaaggg

SEQ ID NO: 11556 - DNA, 21 bp, Homo Sapiens
  primer_bind 1..21: downstream amplification primer 99-9751 for SEQ 3691, in complement
ccccatcttcgtacaacctac

SEQ ID NO: 11557 - DNA, 19 bp, Homo Sapiens
  primer_bind 1..19: downstream amplification primer 99-9765 for SEQ 3692, in complement
gaatggaagtctatgtgtc

SEQ ID NO: 11558 - DNA, 20 bp, Homo Sapiens
  primer_bind 1..20: downstream amplification primer 99-9774 for SEQ 3693, in complement
atagatgaaccttgggaatg

SEQ ID NO: 11559 - DNA, 21 bp, Homo Sapiens
  primer_bind 1..21: downstream amplification primer 99-9778 for SEQ 3694, in complement
acatctgagtttttccttccc

SEQ ID NO: 11560 - DNA, 20 bp, Homo Sapiens
  primer_bind 1..20: downstream amplification primer 99-9781 for SEQ 3695, in complement
actcctactgatattctgac

SEQ ID NO: 11561 - DNA, 21 bp, Homo Sapiens
  primer_bind 1..21: downstream amplification primer 99-9785 for SEQ 3696, in complement
ttttctggtaaagacttaggg

SEQ ID NO: 11562 - DNA, 20 bp, Homo Sapiens
  primer_bind 1..20: downstream amplification primer 99-9810 for SEQ 3697, in complement
ccagtttctacaaaaaagtc

SEQ ID NO: 11563 - DNA, 21 bp, Homo Sapiens
  primer_bind 1..21: downstream amplification primer 99-9811 for SEQ 3698, in complement
atgagtcagaaaatccagaag

SEQ ID NO: 11564 - DNA, 21 bp, Homo Sapiens
  primer_bind 1..21: downstream amplification primer 99-9820 for SEQ 3699, in complement
aatagcctctgtatcttcccc

SEQ ID NO: 11565 - DNA, 20 bp, Homo Sapiens
  primer_bind 1..20: downstream amplification primer 99-9822 for SEQ 3700, in complement
gtagttcataattgatcccc

SEQ ID NO: 11566 - DNA, 21 bp, Homo Sapiens
  primer_bind 1..21: downstream amplification primer 99-9829 for SEQ 3701, in complement
gggaagaacaatgaacaactg

SEQ ID NO: 11567 - DNA, 21 bp, Homo Sapiens
  primer_bind 1..21: downstream amplification primer 99-983 for SEQ 3702, in complement
taggtttcaggtaaaaagcac

SEQ ID NO: 11568 - DNA, 18 bp, Homo Sapiens
  primer_bind 1..18: downstream amplification primer 99-9832 for SEQ 3703, in complement
accacacctagccataac

SEQ ID NO: 11569 - DNA, 21 bp, Homo Sapiens
  primer_bind 1..21: downstream amplification primer 99-9833 for SEQ 3704, in complement
tcacctcctttagaaattgcc

SEQ ID NO: 11570 - DNA, 21 bp, Homo Sapiens
  primer_bind 1..21: downstream amplification primer 99-9835 for SEQ 3705, in complement
acttctactaataccagtatc

SEQ ID NO: 11571 - DNA, 21 bp, Homo Sapiens
  primer_bind 1..21: downstream amplification primer 99-9837 for SEQ 3706, in complement
caaaggatggcagaagacagg

SEQ ID NO: 11572 - DNA, 21 bp, Homo Sapiens
  primer_bind 1..21: downstream amplification primer 99-9839 for SEQ 3707, in complement
ataaaggcataaaacaaggag

SEQ ID NO: 11573 - DNA, 21 bp, Homo Sapiens
  primer_bind 1..21: downstream amplification primer 99-9840 for SEQ 3708, in complement
atggcagttttaaattcaacc

SEQ ID NO: 11574 - DNA, 18 bp, Homo Sapiens
  primer_bind 1..18: downstream amplification primer 99-9847 for SEQ 3709, in complement
acagaggagacactcaac

SEQ ID NO: 11575 - DNA, 18 bp, Homo Sapiens
  primer_bind 1..18: downstream amplification primer 99-9849 for SEQ 3710, in complement
atgcaaccaactggatac

SEQ ID NO: 11576 - DNA, 18 bp, Homo Sapiens
  primer_bind 1..18: downstream amplification primer 99-9852 for SEQ 3711, in complement
ctggttggataaagagtg

SEQ ID NO: 11577 - DNA, 21 bp, Homo Sapiens
  primer_bind 1..21: downstream amplification primer 99-9854 for SEQ 3712, in complement
cttctgtcagtgtaactgtgg

SEQ ID NO: 11578 - DNA, 18 bp, Homo Sapiens
  primer_bind 1..18: downstream amplification primer 99-9856 for SEQ 3713, in complement
agaagaggcaagaagtgg

SEQ ID NO: 11579 - DNA, 21 bp, Homo Sapiens
  primer_bind 1..21: downstream amplification primer 99-9859 for SEQ 3714, in complement
tattctttattgggattgtgg

SEQ ID NO: 11580 - DNA, 20 bp, Homo Sapiens
  primer_bind 1..20: downstream amplification primer 99-9866 for SEQ 3715, in complement
aagcagcccctatctggaac

SEQ ID NO: 11581 - DNA, 19 bp, Homo Sapiens
  primer_bind 1..19: downstream amplification primer 99-990 for SEQ 3716, in complement
agggaagaatggagggatg

SEQ ID NO: 11582 - DNA, 21 bp, Homo Sapiens
  primer_bind 1..21: downstream amplification primer 99-9906 for SEQ 3717, in complement
cttcttatgtctgctaatggg

SEQ ID NO: 11583 - DNA, 21 bp, Homo Sapiens
  primer_bind 1..21: downstream amplification primer 99-9908 for SEQ 3718, in complement
taatcaagcctcctgtccttc

SEQ ID NO: 11584 - DNA, 19 bp, Homo Sapiens
  primer_bind 1..19: downstream amplification primer 99-991 for SEQ 3719, in complement
caagaagattctaccccac

SEQ ID NO: 11585 - DNA, 21 bp, Homo Sapiens
  primer_bind 1..21: downstream amplification primer 99-9915 for SEQ 3720, in complement
ttttgtttggttttgtggatg

SEQ ID NO: 11586 - DNA, 20 bp, Homo Sapiens
  primer_bind 1..20: downstream amplification primer 99-9920 for SEQ 3721, in complement
tgtgaggttcttactgtgag

SEQ ID NO: 11587 - DNA, 21 bp, Homo Sapiens
  primer_bind 1..21: downstream amplification primer 99-9921 for SEQ 3722, in complement
ttaattgatggggaggtagag

SEQ ID NO: 11588 - DNA, 21 bp, Homo Sapiens
  primer_bind 1..21: downstream amplification primer 99-9922 for SEQ 3723, in complement
gatgtggaatatgttagtcag

SEQ ID NO: 11589 - DNA, 21 bp, Homo Sapiens
  primer_bind 1..21: downstream amplification primer 99-9926 for SEQ 3724, in complement
gagcagtaatgttttattgag

SEQ ID NO: 11590 - DNA, 18 bp, Homo Sapiens
  primer_bind 1..18: downstream amplification primer 99-9928 for SEQ 3725, in complement
ggtttcataatgggggtc

SEQ ID NO: 11591 - DNA, 19 bp, Homo Sapiens
  primer_bind 1..19: downstream amplification primer 99-9929 for SEQ 3726, in complement
tttgctccgagacacacac

SEQ ID NO: 11592 - DNA, 20 bp, Homo Sapiens
  primer_bind 1..20: downstream amplification primer 99-9935 for SEQ 3727, in complement
gcctgtgtattaccaattcc

SEQ ID NO: 11593 - DNA, 18 bp, Homo Sapiens
  primer_bind 1..18: downstream amplification primer 99-9941 for SEQ 3728, in complement
gacagaaggtgtggttag

SEQ ID NO: 11594 - DNA, 18 bp, Homo Sapiens
  primer_bind 1..18: downstream amplification primer 99-995 for SEQ 3729, in complement
attgtgttgtgctcttcc

SEQ ID NO: 11595 - DNA, 18 bp, Homo Sapiens
  primer_bind 1..18: downstream amplification primer 99-996 for SEQ 3730, in complement
tgttagggttgaaaggtg

SEQ ID NO: 11596 - DNA, 21 bp, Homo Sapiens
  primer_bind 1..21: downstream amplification primer 99-9986 for SEQ 3731, in complement
gaaagagcaagtgtgtattag

SEQ ID NO: 11597 - DNA, 21 bp, Homo Sapiens
  primer_bind 1..21: downstream amplification primer 99-9988 for SEQ 3732, in complement
gaggataaaagtaaggtgtgg

SEQ ID NO: 11598 - DNA, 18 bp, Homo Sapiens
  primer_bind 1..18: downstream amplification primer 99-9994 for SEQ 3733, in complement
ttctgtggactgacattg

SEQ ID NO: 11599 - DNA, 20 bp, Homo Sapiens
  primer_bind 1..20: downstream amplification primer 99-9995 for SEQ 3734, in complement
gtgtaacagatacttcttcc

SEQ ID NO: 11600 - DNA, 21 bp, Homo Sapiens
  primer_bind 1..21: downstream amplification primer 99-10069 for SEQ 3735, in complement
cttgggaaattctcaaatggg

SEQ ID NO: 11601 - DNA, 21 bp, Homo Sapiens
  primer_bind 1..21: downstream amplification primer 99-10074 for SEQ 3736, in complement
caatatttgtaaagaaacccc

SEQ ID NO: 11602 - DNA, 18 bp, Homo Sapiens
  primer_bind 1..18: downstream amplification primer 99-10129 for SEQ 3737, in complement
ttcccacagagagcttac

SEQ ID NO: 11603 - DNA, 21 bp, Homo Sapiens
  primer_bind 1..21: downstream amplification primer 99-10198 for SEQ 3738, in complement
gaccgaaaagaaatatatacc

SEQ ID NO: 11604 - DNA, 21 bp, Homo Sapiens
  primer_bind 1..21: downstream amplification primer 99-10306 for SEQ 3739, in complement
ggaggaatgactgaatagttg

SEQ ID NO: 11605 - DNA, 20 bp, Homo Sapiens
  primer_bind 1..20: downstream amplification primer 99-10307 for SEQ 3740, in complement
tttccccaccccaatcaatc

SEQ ID NO: 11606 - DNA, 21 bp, Homo Sapiens
  primer_bind 1..21: downstream amplification primer 99-10326 for SEQ 3741, in complement
aaaagatgtagggttagatgg

SEQ ID NO: 11607 - DNA, 21 bp, Homo Sapiens
  primer_bind 1..21: downstream amplification primer 99-10393 for SEQ 3742, in complement
atcctgttctctgcaagtttc

SEQ ID NO: 11608 - DNA, 21 bp, Homo Sapiens
  primer_bind 1..21: downstream amplification primer 99-10685 for SEQ 3743, in complement
ttaggtggggaaaatgattgg

SEQ ID NO: 11609 - DNA, 20 bp, Homo Sapiens
  primer_bind 1..20: downstream amplification primer 99-10857 for SEQ 3744, in complement
ctctacttactatatacacc

SEQ ID NO: 11610 - DNA, 19 bp, Homo Sapiens
  primer_bind 1..19: downstream amplification primer 99-10948 for SEQ 3745, in complement
ccagttatatcatcttgtc

SEQ ID NO: 11611 - DNA, 21 bp, Homo Sapiens
  primer_bind 1..21: downstream amplification primer 99-11104 for SEQ 3746, in complement
ggttcgtttaatgccactctc

SEQ ID NO: 11612 - DNA, 20 bp, Homo Sapiens
  primer_bind 1..20: downstream amplification primer 99-11116 for SEQ 3747, in complement
gcccaccaagtaaaaagacc

SEQ ID NO: 11613 - DNA, 20 bp, Homo Sapiens
  primer_bind 1..20: downstream amplification primer 99-11117 for SEQ 3748, in complement
atatcagcaaagaaagggag

SEQ ID NO: 11614 - DNA, 21 bp, Homo Sapiens
  primer_bind 1..21: downstream amplification primer 99-11121 for SEQ 3749, in complement
taaaatacctgcatccccacc

SEQ ID NO: 11615 - DNA, 21 bp, Homo Sapiens
  primer_bind 1..21: downstream amplification primer 99-11124 for SEQ 3750, in complement
aaatggattggctggctttgg

SEQ ID NO: 11616 - DNA, 20 bp, Homo Sapiens
  primer_bind 1..20: downstream amplification primer 99-11172 for SEQ 3751, in complement
ctgagtgcctgctgtctttg

SEQ ID NO: 11617 - DNA, 20 bp, Homo Sapiens
  primer_bind 1..20: downstream amplification primer 99-11206 for SEQ 3752, in complement
aagatatggaagagggagag

SEQ ID NO: 11618 - DNA, 20 bp, Homo Sapiens
  primer_bind 1..20: downstream amplification primer 99-11303 for SEQ 3753, in complement
agccccttccaacaccaaag

SEQ ID NO: 11619 - DNA, 21 bp, Homo Sapiens
  primer_bind 1..21: downstream amplification primer 99-11307 for SEQ 3754, in complement
gtggggaaagagaaaggaagg

SEQ ID NO: 11620 - DNA, 21 bp, Homo Sapiens
  primer_bind 1..21: downstream amplification primer 99-11325 for SEQ 3755, in complement
tttcaggctctgcttaacagg

SEQ ID NO: 11621 - DNA, 21 bp, Homo Sapiens
  primer_bind 1..21: downstream amplification primer 99-11365 for SEQ 3756, in complement
attcctcttgctgcccttaac

SEQ ID NO: 11622 - DNA, 20 bp, Homo Sapiens
  primer_bind 1..20: downstream amplification primer 99-11389 for SEQ 3757, in complement
tcaagatggagtcactctgg

SEQ ID NO: 11623 - DNA, 21 bp, Homo Sapiens
  primer_bind 1..21: downstream amplification primer 99-11395 for SEQ 3758, in complement
acagaaaccagggaaaggaac

SEQ ID NO: 11624 - DNA, 21 bp, Homo Sapiens
  primer_bind 1..21: downstream amplification primer 99-11500 for SEQ 3759, in complement
ggtaaggggtgatattgtggg

SEQ ID NO: 11625 - DNA, 21 bp, Homo Sapiens
  primer_bind 1..21: downstream amplification primer 99-11571 for SEQ 3760, in complement
actttgcctcattttgtgctc

SEQ ID NO: 11626 - DNA, 21 bp, Homo Sapiens
  primer_bind 1..21: downstream amplification primer 99-11710 for SEQ 3761, in complement
tgtcccaagcccttttttacc

SEQ ID NO: 11627 - DNA, 18 bp, Homo Sapiens
  primer_bind 1..18: downstream amplification primer 99-1173 for SEQ 3762, in complement
ttcaaggtactgtccatc

SEQ ID NO: 11628 - DNA, 21 bp, Homo Sapiens
  primer_bind 1..21: downstream amplification primer 99-11735 for SEQ 3763, in complement
taactgaaactatggttttgg

SEQ ID NO: 11629 - DNA, 20 bp, Homo Sapiens
  primer_bind 1..20: downstream amplification primer 99-11864 for SEQ 3764, in complement
aagagtccttagccacctcc

SEQ ID NO: 11630 - DNA, 20 bp, Homo Sapiens
  primer_bind 1..20: downstream amplification primer 99-1187 for SEQ 3765, in complement
gagactggagaaatgaaatg

SEQ ID NO: 11631 - DNA, 21 bp, Homo Sapiens
  primer_bind 1..21: downstream amplification primer 99-11872 for SEQ 3766, in complement
ttagggaagggtaggtatatg

SEQ ID NO: 11632 - DNA, 20 bp, Homo Sapiens
  primer_bind 1..20: downstream amplification primer 99-11878 for SEQ 3767, in complement
ccccagcattaggtgttatc

SEQ ID NO: 11633 - DNA, 21 bp, Homo Sapiens
  primer_bind 1..21: downstream amplification primer 99-11905 for SEQ 3768, in complement
gtccctcaactgtgataattc

SEQ ID NO: 11634 - DNA, 20 bp, Homo Sapiens
  primer_bind 1..20: downstream amplification primer 99-11932 for SEQ 3769, in complement
gagaatagctctccttcctg

SEQ ID NO: 11635 - DNA, 20 bp, Homo Sapiens
  primer_bind 1..20: downstream amplification primer 99-11964 for SEQ 3770, in complement
gcatctgcaagtaggaaggg

SEQ ID NO: 11636 - DNA, 21 bp, Homo Sapiens
  primer_bind 1..21: downstream amplification primer 99-12164 for SEQ 3771, in complement
atgggtcaagttctatatgtc

SEQ ID NO: 11637 - DNA, 21 bp, Homo Sapiens
  primer_bind 1..21: downstream amplification primer 99-12227 for SEQ 3772, in complement
catagttggctcattctcatc

SEQ ID NO: 11638 - DNA, 20 bp, Homo Sapiens
  primer_bind 1..20: downstream amplification primer 99-12417 for SEQ 3773, in complement
tggcttctgactcagaggac

SEQ ID NO: 11639 - DNA, 20 bp, Homo Sapiens
  primer_bind 1..20: downstream amplification primer 99-12459 for SEQ 3774, in complement
tgcagactgtaagcacagcc

SEQ ID NO: 11640 - DNA, 19 bp, Homo Sapiens
  primer_bind 1..19: downstream amplification primer 99-12521 for SEQ 3775, in complement
aagctaaatccagcggcag

SEQ ID NO: 11641 - DNA, 21 bp, Homo Sapiens
  primer_bind 1..21: downstream amplification primer 99-12569 for SEQ 3776, in complement
gagagacagattgaccagttc

SEQ ID NO: 11642 - DNA, 21 bp, Homo Sapiens
  primer_bind 1..21: downstream amplification primer 99-1298 for SEQ 3777, in complement
caaaattaacccaaaaaccag

SEQ ID NO: 11643 - DNA, 18 bp, Homo Sapiens
  primer_bind 1..18: downstream amplification primer 99-1315 for SEQ 3778, in complement
tattcacttcttgctggg

SEQ ID NO: 11644 - DNA, 21 bp, Homo Sapiens
  primer_bind 1..21: downstream amplification primer 99-13154 for SEQ 3779, in complement
aagtatttgaaggggctgagg

SEQ ID NO: 11645 - DNA, 21 bp, Homo Sapiens
  primer_bind 1..21: downstream amplification primer 99-13155 for SEQ 3780, in complement
acctaaaataatcccacttac

SEQ ID NO: 11646 - DNA, 19 bp, Homo Sapiens
  primer_bind 1..19: downstream amplification primer 99-13249 for SEQ 3781, in complement
agggaaaactggacttcgg

SEQ ID NO: 11647 - DNA, 21 bp, Homo Sapiens
  primer_bind 1..21: downstream amplification primer 99-13794 for SEQ 3782, in complement
tcttcaggtctggaaagtatg

SEQ ID NO: 11648 - DNA, 21 bp, Homo Sapiens
  primer_bind 1..21: downstream amplification primer 99-14899 for SEQ 3783, in complement
cgacactcaatagagattagg

SEQ ID NO: 11649 - DNA, 18 bp, Homo Sapiens
  primer_bind 1..18: downstream amplification primer 99-16351 for SEQ 3784, in complement
agatgatactcaaggagg

SEQ ID NO: 11650 - DNA, 21 bp, Homo Sapiens
  primer_bind 1..21: downstream amplification primer 99-16436 for SEQ 3785, in complement
gtcaaaggacaaaactacaac

SEQ ID NO: 11651 - DNA, 20 bp, Homo Sapiens
  primer_bind 1..20: downstream amplification primer 99-16753 for SEQ 3786, in complement
gaacaacattcaaggcaaac

SEQ ID NO: 11652 - DNA, 20 bp, Homo Sapiens
  primer_bind 1..20: downstream amplification primer 99-1807 for SEQ 3787, in complement
gtctgtgaatgtaactgatg

SEQ ID NO: 11653 - DNA, 20 bp, Homo Sapiens
  primer_bind 1..20: downstream amplification primer 99-19032 for SEQ 3788, in complement
ttggaaaacaccagccccag

SEQ ID NO: 11654 - DNA, 20 bp, Homo Sapiens
  primer_bind 1..20: downstream amplification primer 99-19212 for SEQ 3789, in complement
tgaggtgaggaaaacgacag

SEQ ID NO: 11655 - DNA, 20 bp, Homo Sapiens
  primer_bind 1..20: downstream amplification primer 99-19273 for SEQ 3790, in complement
actgtgcccatcctgctaac

SEQ ID NO: 11656 - DNA, 21 bp, Homo Sapiens
  primer_bind 1..21: downstream amplification primer 99-19279 for SEQ 3791, in complement
ctagggaaaagacatctatgg

SEQ ID NO: 11657 - DNA, 21 bp, Homo Sapiens
  primer_bind 1..21: downstream amplification primer 99-19541 for SEQ 3792, in complement
ggtctaaataataaagtgagg

SEQ ID NO: 11658 - DNA, 20 bp, Homo Sapiens
  primer_bind 1..20: downstream amplification primer 99-19552 for SEQ 3793, in complement
tagctgaaactgctcccacc

SEQ ID NO: 11659 - DNA, 20 bp, Homo Sapiens
  primer_bind 1..20: downstream amplification primer 99-21051 for SEQ 3794, in complement
aagtaaggtgtatgtgtttg

SEQ ID NO: 11660 - DNA, 18 bp, Homo Sapiens
  primer_bind 1..18: downstream amplification primer 99-21246 for SEQ 3795, in complement
attcaatggggctattgg

SEQ ID NO: 11661 - DNA, 21 bp, Homo Sapiens
  primer_bind 1..21: downstream amplification primer 99-21387 for SEQ 3796, in complement
catcttctgtcatcaaaagtc

SEQ ID NO: 11662 - DNA, 21 bp, Homo Sapiens
  primer_bind 1..21: downstream amplification primer 99-21407 for SEQ 3797, in complement
caactctaagcaaggtgaggg

SEQ ID NO: 11663 - DNA, 21 bp, Homo Sapiens
  primer_bind 1..21: downstream amplification primer 99-21418 for SEQ 3798, in complement
gtttggttgttactcgcatgg

SEQ ID NO: 11664 - DNA, 21 bp, Homo Sapiens
  primer_bind 1..21: downstream amplification primer 99-21419 for SEQ 3799, in complement
aacccatcatcttcctcctcc

SEQ ID NO: 11665 - DNA, 18 bp, Homo Sapiens
  primer_bind 1..18: downstream amplification primer 99-21430 for SEQ 3800, in complement
ctctatggtctcttgtgg

SEQ ID NO: 11666 - DNA, 21 bp, Homo Sapiens
  primer_bind 1..21: downstream amplification primer 99-21435 for SEQ 3801, in complement
ttctgccaggttactctctgc

SEQ ID NO: 11667 - DNA, 21 bp, Homo Sapiens
  primer_bind 1..21: downstream amplification primer 99-21446 for SEQ 3802, in complement
cacacccatctacccagtttc

SEQ ID NO: 11668 - DNA, 21 bp, Homo Sapiens
  primer_bind 1..21: downstream amplification primer 99-21452 for SEQ 3803, in complement
gctcacattgtctggtttctc

SEQ ID NO: 11669 - DNA, 21 bp, Homo Sapiens
  primer_bind 1..21: downstream amplification primer 99-21488 for SEQ 3804, in complement
atggtagatggcattaaggag

SEQ ID NO: 11670 - DNA, 21 bp, Homo Sapiens
  primer_bind 1..21: downstream amplification primer 99-21489 for SEQ 3805, in complement
atctgttagtgaaaatctgtg

SEQ ID NO: 11671 - DNA, 21 bp, Homo Sapiens
  primer_bind 1..21: downstream amplification primer 99-21496 for SEQ 3806, in complement
cgagccttcagtttcagcatc

SEQ ID NO: 11672 - DNA, 18 bp, Homo Sapiens
  primer_bind 1..18: downstream amplification primer 99-21519 for SEQ 3807, in complement
tgctgcctaaccatttgc

SEQ ID NO: 11673 - DNA, 21 bp, Homo Sapiens
  primer_bind 1..21: downstream amplification primer 99-21618 for SEQ 3808, in complement
agcagagaaattgcccaagac

SEQ ID NO: 11674 - DNA, 21 bp, Homo Sapiens
  primer_bind 1..21: downstream amplification primer 99-21725 for SEQ 3809, in complement
atgccagacgaggatatgtag

SEQ ID NO: 11675 - DNA, 19 bp, Homo Sapiens
  primer_bind 1..19: downstream amplification primer 99-21773 for SEQ 3810, in complement
tccctccctacacactaac

SEQ ID NO: 11676 - DNA, 19 bp, Homo Sapiens
  primer_bind 1..19: downstream amplification primer 99-21781 for SEQ 3811, in complement
agccaacagcagtgtgtcc

SEQ ID NO: 11677 - DNA, 21 bp, Homo Sapiens
  primer_bind 1..21: downstream amplification primer 99-21820 for SEQ 3812, in complement
tagtcttgcctaatgtttttg

SEQ ID NO: 11678 - DNA, 19 bp, Homo Sapiens
  primer_bind 1..19: downstream amplification primer 99-21822 for SEQ 3813, in complement
acgatgttctgagggacac

SEQ ID NO: 11679 - DNA, 21 bp, Homo Sapiens
  primer_bind 1..21: downstream amplification primer 99-21939 for SEQ 3814, in complement
acgggtttagaataggttgag

SEQ ID NO: 11680 - DNA, 21 bp, Homo Sapiens
  primer_bind 1..21: downstream amplification primer 99-22404 for SEQ 3815, in complement
tctcttcttcccttcctcctc

SEQ ID NO: 11681 - DNA, 19 bp, Homo Sapiens
  primer_bind 1..19: downstream amplification primer 99-22594 for SEQ 3816, in complement
agtgtgcgggtaatgtctg

SEQ ID NO: 11682 - DNA, 21 bp, Homo Sapiens
  primer_bind 1..21: downstream amplification primer 99-22679 for SEQ 3817, in complement
ttctgaatgtgtgtctctgcc

SEQ ID NO: 11683 - DNA, 21 bp, Homo Sapiens
  primer_bind 1..21: downstream amplification primer 99-23095 for SEQ 3818, in complement
tctatctactgccaaccacac

SEQ ID NO: 11684 - DNA, 18 bp, Homo Sapiens
  primer_bind 1..18: downstream amplification primer 99-23370 for SEQ 3819, in complement
agggttgtcaaggtaatc

SEQ ID NO: 11685 - DNA, 19 bp, Homo Sapiens
  primer_bind 1..19: downstream amplification primer 99-23568 for SEQ 3820, in complement
gcgagcagttgttttttac

SEQ ID NO: 11686 - DNA, 21 bp, Homo Sapiens
  primer_bind 1..21: downstream amplification primer 99-23824 for SEQ 3821, in complement
tcccaagtcctagaatctgag

SEQ ID NO: 11687 - DNA, 21 bp, Homo Sapiens
  primer_bind 1..21: downstream amplification primer 99-23969 for SEQ 3822, in complement
gaagattttgtcccagttaag

SEQ ID NO: 11688 - DNA, 20 bp, Homo Sapiens
  primer_bind 1..20: downstream amplification primer 99-24032 for SEQ 3823, in complement
acggatggtcaggatagagc

SEQ ID NO: 11689 - DNA, 20 bp, Homo Sapiens
  primer_bind 1..20: downstream amplification primer 99-24048 for SEQ 3824, in complement
tggagagcgattccttggac

SEQ ID NO: 11690 - DNA, 21 bp, Homo Sapiens
  primer_bind 1..21: downstream amplification primer 99-24074 for SEQ 3825, in complement
ttgcctgcttgtcctctttcc

SEQ ID NO: 11691 - DNA, 20 bp, Homo Sapiens
  primer_bind 1..20: downstream amplification primer 99-24082 for SEQ 3826, in complement
ccagactggagagtcttgag

SEQ ID NO: 11692 - DNA, 21 bp, Homo Sapiens
  primer_bind 1..21: downstream amplification primer 99-24104 for SEQ 3827, in complement
gttcattcagtttgattcccc

SEQ ID NO: 11693 - DNA, 20 bp, Homo Sapiens
  primer_bind 1..20: downstream amplification primer 99-24138 for SEQ 3828, in complement
agaaagatggcagcatcggg

SEQ ID NO: 11694 - DNA, 21 bp, Homo Sapiens
  primer_bind 1..21: downstream amplification primer 99-24172 for SEQ 3829, in complement
tccactctgactgattagaac

SEQ ID NO: 11695 - DNA, 20 bp, Homo Sapiens
  primer_bind 1..20: downstream amplification primer 99-24267 for SEQ 3830, in complement
gccgcagataattaatggac

SEQ ID NO: 11696 - DNA, 20 bp, Homo Sapiens
  primer_bind 1..20: downstream amplification primer 99-24949 for SEQ 3831, in complement
actctggctccttttcccac

SEQ ID NO: 11697 - DNA, 20 bp, Homo Sapiens
  primer_bind 1..20: downstream amplification primer 99-253 for SEQ 3832, in complement
tttcttcaccatttttctcc

SEQ ID NO: 11698 - DNA, 21 bp, Homo Sapiens
  primer_bind 1..21: downstream amplification primer 99-2694 for SEQ 3833, in complement
atcgtctgtgcctttttcttg

SEQ ID NO: 11699 - DNA, 20 bp, Homo Sapiens
  primer_bind 1..20: downstream amplification primer 99-2697 for SEQ 3834, in complement
atatctctgctcctcctaac

SEQ ID NO: 11700 - DNA, 21 bp, Homo Sapiens
  primer_bind 1..21: downstream amplification primer 99-2720 for SEQ 3835, in complement
tctaacgcatctgctgcctac

SEQ ID NO: 11701 - DNA, 21 bp, Homo Sapiens
  primer_bind 1..21: downstream amplification primer 99-2851 for SEQ 3836, in complement
ttggactttctgctttaaggg

SEQ ID NO: 11702 - DNA, 20 bp, Homo Sapiens
  primer_bind 1..20: downstream amplification primer 99-2889 for SEQ 3837, in complement
cttgagggaatttcatggtc

SEQ ID NO: 11703 - DNA, 20 bp, Homo Sapiens
  primer_bind 1..20: downstream amplification primer 99-3072 for SEQ 3838, in complement
ctcagacctttcagttttcc

SEQ ID NO: 11704 - DNA, 21 bp, Homo Sapiens
  primer_bind 1..21: downstream amplification primer 99-3089 for SEQ 3839, in complement
agaaatgctgagtgataagtg

SEQ ID NO: 11705 - DNA, 20 bp, Homo Sapiens
  primer_bind 1..20: downstream amplification primer 99-3157 for SEQ 3840, in complement
agtaagagtaaacagggatg

SEQ ID NO: 11706 - DNA, 18 bp, Homo Sapiens
  primer_bind 1..18: downstream amplification primer 99-3210 for SEQ 3841, in complement
catcctctcctttgttcc

SEQ ID NO: 11707 - DNA, 21 bp, Homo Sapiens
  primer_bind 1..21: downstream amplification primer 99-3218 for SEQ 3842, in complement
aagtcacttttcgtggtttgg

SEQ ID NO: 11708 - DNA, 21 bp, Homo Sapiens
  primer_bind 1..21: downstream amplification primer 99-3251 for SEQ 3843, in complement
cacgtactgcttaaacaaagg

SEQ ID NO: 11709 - DNA, 21 bp, Homo Sapiens
  primer_bind 1..21: downstream amplification primer 99-3298 for SEQ 3844, in complement
tgttgggaggataaaatgaag

SEQ ID NO: 11710 - DNA, 18 bp, Homo Sapiens
  primer_bind 1..18: downstream amplification primer 99-3300 for SEQ 3845, in complement
tttgccctttaaaagccc

SEQ ID NO: 11711 - DNA, 21 bp, Homo Sapiens
  primer_bind 1..21: downstream amplification primer 99-3364 for SEQ 3846, in complement
cgtattcagcacaatgtcacc

SEQ ID NO: 11712 - DNA, 20 bp, Homo Sapiens
  primer_bind 1..20: downstream amplification primer 99-3427 for SEQ 3847, in complement
aggctgatgtggtgggaaac

SEQ ID NO: 11713 - DNA, 21 bp, Homo Sapiens
  primer_bind 1..21: downstream amplification primer 99-3484 for SEQ 3848, in complement
catgagaatagccttgtctcc

SEQ ID NO: 11714 - DNA, 21 bp, Homo Sapiens
  primer_bind 1..21: downstream amplification primer 99-3537 for SEQ 3849, in complement
caaacccaactttagctttcc

SEQ ID NO: 11715 - DNA, 18 bp, Homo Sapiens
  primer_bind 1..18: downstream amplification primer 99-3568 for SEQ 3850, in complement
gcaatgaagtcactgtgg

SEQ ID NO: 11716 - DNA, 21 bp, Homo Sapiens
  primer_bind 1..21: downstream amplification primer 99-3592 for SEQ 3851, in complement
tgcacacagtgacttccttcc

SEQ ID NO: 11717 - DNA, 21 bp, Homo Sapiens
  primer_bind 1..21: downstream amplification primer 99-3602 for SEQ 3852, in complement
acacccatccattccatcctc

SEQ ID NO: 11718 - DNA, 21 bp, Homo Sapiens
  primer_bind 1..21: downstream amplification primer 99-3608 for SEQ 3853, in complement
caagctaagatcaggagaaac

SEQ ID NO: 11719 - DNA, 21 bp, Homo Sapiens
  primer_bind 1..21: downstream amplification primer 99-3643 for SEQ 3854, in complement
tcttctttggtttgtttactg

SEQ ID NO: 11720 - DNA, 19 bp, Homo Sapiens
  primer_bind 1..19: downstream amplification primer 99-3770 for SEQ 3855, in complement
gggaaaaacagagagaaac

SEQ ID NO: 11721 - DNA, 19 bp, Homo Sapiens
  primer_bind 1..19: downstream amplification primer 99-3772 for SEQ 3856, in complement
gatattaagaaagatgccc

SEQ ID NO: 11722 - DNA, 20 bp, Homo Sapiens
  primer_bind 1..20: downstream amplification primer 99-3790 for SEQ 3857, in complement
gcagagatgttgggttgtgg

SEQ ID NO: 11723 - DNA, 20 bp, Homo Sapiens
  primer_bind 1..20: downstream amplification primer 99-3818 for SEQ 3858, in complement
aagtcctttagtctgctttc

SEQ ID NO: 11724 - DNA, 21 bp, Homo Sapiens
  primer_bind 1..21: downstream amplification primer 99-3863 for SEQ 3859, in complement
gacatcattaaggatcagtgg

SEQ ID NO: 11725 - DNA, 20 bp, Homo Sapiens
  primer_bind 1..20: downstream amplification primer 99-3879 for SEQ 3860, in complement
gccaaatccacttctgagac

SEQ ID NO: 11726 - DNA, 20 bp, Homo Sapiens
  primer_bind 1..20: downstream amplification primer 99-3882 for SEQ 3861, in complement
actcacctgaatatgaagac

SEQ ID NO: 11727 - DNA, 19 bp, Homo Sapiens
  primer_bind 1..19: downstream amplification primer 99-3883 for SEQ 3862, in complement
aggtaaaaacatccaagag

SEQ ID NO: 11728 - DNA, 19 bp, Homo Sapiens
  primer_bind 1..19: downstream amplification primer 99-3884 for SEQ 3863, in complement
gaacaaatccaagtgaacc

SEQ ID NO: 11729 - DNA, 20 bp, Homo Sapiens
  primer_bind 1..20: downstream amplification primer 99-3894 for SEQ 3864, in complement
tctcctcttctgcccaactc

SEQ ID NO: 11730 - DNA, 19 bp, Homo Sapiens
  primer_bind 1..19: downstream amplification primer 99-3936 for SEQ 3865, in complement
gcaaaaaattcacaccccc

SEQ ID NO: 11731 - DNA, 21 bp, Homo Sapiens
  primer_bind 1..21: downstream amplification primer 99-3946 for SEQ 3866, in complement
ccccattaagaacacaaccac

SEQ ID NO: 11732 - DNA, 20 bp, Homo Sapiens
  primer_bind 1..20: downstream amplification primer 99-4029 for SEQ 3867, in complement
gatctggagagacgtggaag

SEQ ID NO: 11733 - DNA, 21 bp, Homo Sapiens
  primer_bind 1..21: downstream amplification primer 99-4036 for SEQ 3868, in complement
agaatttgatgtatctgatgg

SEQ ID NO: 11734 - DNA, 20 bp, Homo Sapiens
  primer_bind 1..20: downstream amplification primer 99-4102 for SEQ 3869, in complement
cacagataaaattcgaggac

SEQ ID NO: 11735 - DNA, 18 bp, Homo Sapiens
  primer_bind 1..18: downstream amplification primer 99-4110 for SEQ 3870, in complement
gccaaaccccagcatagc

SEQ ID NO: 11736 - DNA, 21 bp, Homo Sapiens
  primer_bind 1..21: downstream amplification primer 99-4111 for SEQ 3871, in complement
aaagggggatgggtaattatg

SEQ ID NO: 11737 - DNA, 19 bp, Homo Sapiens
  primer_bind 1..19: downstream amplification primer 99-4126 for SEQ 3872, in complement
tatggttggctaaggttgg

SEQ ID NO: 11738 - DNA, 19 bp, Homo Sapiens
  primer_bind 1..19: downstream amplification primer 99-4157 for SEQ 3873, in complement
ttggaaacagaagtagtag

SEQ ID NO: 11739 - DNA, 18 bp, Homo Sapiens
  primer_bind 1..18: downstream amplification primer 99-4228 for SEQ 3874, in complement
ttgagcctcgtcatgttg

SEQ ID NO: 11740 - DNA, 20 bp, Homo Sapiens
  primer_bind 1..20: downstream amplification primer 99-4239 for SEQ 3875, in complement
aacaccctagccattaaatc

SEQ ID NO: 11741 - DNA, 18 bp, Homo Sapiens
  primer_bind 1..18: downstream amplification primer 99-4254 for SEQ 3876, in complement
tgggaatggcttactcac

SEQ ID NO: 11742 - DNA, 21 bp, Homo Sapiens
  primer_bind 1..21: downstream amplification primer 99-4264 for SEQ 3877, in complement
attcaccatctgttctctctc

SEQ ID NO: 11743 - DNA, 20 bp, Homo Sapiens
  primer_bind 1..20: downstream amplification primer 99-4311 for SEQ 3878, in complement
aagcatttgaaatctggtag

SEQ ID NO: 11744 - DNA, 21 bp, Homo Sapiens
  primer_bind 1..21: downstream amplification primer 99-4381 for SEQ 3879, in complement
tgagacatacaccagaaaaag

SEQ ID NO: 11745 - DNA, 20 bp, Homo Sapiens
  primer_bind 1..20: downstream amplification primer 99-4403 for SEQ 3880, in complement
gggaagaaggtagaagagtg

SEQ ID NO: 11746 - DNA, 21 bp, Homo Sapiens
  primer_bind 1..21: downstream amplification primer 99-4524 for SEQ 3881, in complement
aagtctgaaacaattctgcgg

SEQ ID NO: 11747 - DNA, 18 bp, Homo Sapiens
  primer_bind 1..18: downstream amplification primer 99-4582 for SEQ 3882, in complement
gcaggtgccctgtctaag

SEQ ID NO: 11748 - DNA, 19 bp, Homo Sapiens
  primer_bind 1..19: downstream amplification primer 99-4611 for SEQ 3883, in complement
tagttcctttagtcccgcc

SEQ ID NO: 11749 - DNA, 19 bp, Homo Sapiens
  primer_bind 1..19: downstream amplification primer 99-4689 for SEQ 3884, in complement
acagtatatgtgtagaagg

SEQ ID NO: 11750 - DNA, 20 bp, Homo Sapiens
  primer_bind 1..20: downstream amplification primer 99-4762 for SEQ 3885, in complement
cgctcttctgccaccaaaac

SEQ ID NO: 11751 - DNA, 21 bp, Homo Sapiens
  primer_bind 1..21: downstream amplification primer 99-4878 for SEQ 3886, in complement
cctgtgacatgagtttacctg

SEQ ID NO: 11752 - DNA, 18 bp, Homo Sapiens
  primer_bind 1..18: downstream amplification primer 99-5075 for SEQ 3887, in complement
aagatactgataggtggg

SEQ ID NO: 11753 - DNA, 21 bp, Homo Sapiens
  primer_bind 1..21: downstream amplification primer 99-5190 for SEQ 3888, in complement
tctcctctaatctcccctacc

SEQ ID NO: 11754 - DNA, 20 bp, Homo Sapiens
  primer_bind 1..20: downstream amplification primer 99-5605 for SEQ 3889, in complement
tcagtttttccagggttttg

SEQ ID NO: 11755 - DNA, 21 bp, Homo Sapiens
  primer_bind 1..21: downstream amplification primer 99-5882 for SEQ 3890, in complement
ctctttgaaatgtagtatctg

SEQ ID NO: 11756 - DNA, 20 bp, Homo Sapiens
  primer_bind 1..20: downstream amplification primer 99-5977 for SEQ 3891, in complement
ccgctgtgaaaatgcagacc

SEQ ID NO: 11757 - DNA, 20 bp, Homo Sapiens
  primer_bind 1..20: downstream amplification primer 99-5993 for SEQ 3892, in complement
gagtgaaatgtgaatagatg

SEQ ID NO: 11758 - DNA, 21 bp, Homo Sapiens
  primer_bind 1..21: downstream amplification primer 99-5994 for SEQ 3893, in complement
attcactggtctgttttgcac

SEQ ID NO: 11759 - DNA, 21 bp, Homo Sapiens
  primer_bind 1..21: downstream amplification primer 99-6827 for SEQ 3894, in complement
gaaattaaagtcagatagccc

SEQ ID NO: 11760 - DNA, 20 bp, Homo Sapiens
  primer_bind 1..20: downstream amplification primer 99-7076 for SEQ 3895, in complement
cccacctatgtgttaaattc

SEQ ID NO: 11761 - DNA, 20 bp, Homo Sapiens
  primer_bind 1..20: downstream amplification primer 99-7215 for SEQ 3896, in complement
aagaagacagagggacagac

SEQ ID NO: 11762 - DNA, 18 bp, Homo Sapiens
  primer_bind 1..18: downstream amplification primer 99-8206 for SEQ 3897, in complement
tcttgcctaagaactgcc

SEQ ID NO: 11763 - DNA, 21 bp, Homo Sapiens
  primer_bind 1..21: downstream amplification primer 99-8614 for SEQ 3898, in complement
caaaagctggaggaaacatgg

SEQ ID NO: 11764 - DNA, 18 bp, Homo Sapiens
  primer_bind 1..18: downstream amplification primer 99-889 for SEQ 3899, in complement
atccttctcccactctac

SEQ ID NO: 11765 - DNA, 21 bp, Homo Sapiens
  primer_bind 1..21: downstream amplification primer 99-9450 for SEQ 3900, in complement
gccacccaaaacaaaaatgag

SEQ ID NO: 11766 - DNA, 20 bp, Homo Sapiens
  primer_bind 1..20: downstream amplification primer 99-9609 for SEQ 3901, in complement
agcaaagaatgatgctgccc

SEQ ID NO: 11767 - DNA, 21 bp, Homo Sapiens
  primer_bind 1..21: downstream amplification primer 99-9612 for SEQ 3902, in complement
tctaaacctaacatttcttcc

SEQ ID NO: 11768 - DNA, 21 bp, Homo Sapiens
  primer_bind 1..21: downstream amplification primer 99-9616 for SEQ 3903, in complement
tggggatgaaatgatggtggg

SEQ ID NO: 11769 - DNA, 20 bp, Homo Sapiens
  primer_bind 1..20: downstream amplification primer 99-9683 for SEQ 3904, in complement
cataaccttcaccctaaatc

SEQ ID NO: 11770 - DNA, 21 bp, Homo Sapiens
  primer_bind 1..21: downstream amplification primer 99-9907 for SEQ 3905, in complement
gagtattttgaagcatggtgg

SEQ ID NO: 11771 - DNA, 19 bp, Homo Sapiens
  primer_bind 1..19: downstream amplification primer 99-993 for SEQ 3906, in complement
tttgggaggatgtttggag

SEQ ID NO: 11772 - DNA, 20 bp, Homo Sapiens
  primer_bind 1..20: downstream amplification primer 99-24069 for SEQ 3907, in complement
aggctttcagtgtggcagtg

SEQ ID NO: 11773 - DNA, 18 bp, Homo Sapiens
  primer_bind 1..18: downstream amplification primer 99-3855 for SEQ 3908, in complement
tttctctctctccatccc

SEQ ID NO: 11774 - DNA, 19 bp, Homo Sapiens
  primer_bind 1..19: downstream amplification primer 99-344 for SEQ 3909, in complement
tggctgcggttagatgctc

SEQ ID NO: 11775 - DNA, 18 bp, Homo Sapiens
  primer_bind 1..18: downstream amplification primer 99-366 for SEQ 3910, in complement
aggggtaactcttgattg

SEQ ID NO: 11776 - DNA, 18 bp, Homo Sapiens
  primer_bind 1..18: downstream amplification primer 99-359 for SEQ 3911, in complement
accaaggcatagcttctc

SEQ ID NO: 11777 - DNA, 18 bp, Homo Sapiens
  primer_bind 1..18: downstream amplification primer 99-355 for SEQ 3912, in complement
atacagccagggagatag

SEQ ID NO: 11778 - DNA, 18 bp, Homo Sapiens
  primer_bind 1..18: downstream amplification primer 99-365 for SEQ 3913, in complement
aattgctacccccaattc

SEQ ID NO: 11779 - DNA, 18 bp, Homo Sapiens
  primer_bind 1..18: downstream amplification primer 99-2452 for SEQ 3914, in complement
tcgaaccagctcttgagg

SEQ ID NO: 11780 - DNA, 18 bp, Homo Sapiens
  primer_bind 1..18: downstream amplification primer 99-123 for SEQ 3915, in complement
tattcagaaaggagtggg

SEQ ID NO: 11781 - DNA, 18 bp, Homo Sapiens
  primer_bind 1..18: downstream amplification primer 4-26 for SEQ 3916, in complement
tgaggactgctaggaaag

SEQ ID NO: 11782 - DNA, 20 bp, Homo Sapiens
  primer_bind 1..20: downstream amplification primer 4-14 for SEQ 3917, in complement
gactgtatcctttgatgcac

SEQ ID NO: 11783 - DNA, 20 bp, Homo Sapiens
  primer_bind 1..20: downstream amplification primer 4-77 for SEQ 3918, in complement
ggaaaggtactcattcatag

SEQ ID NO: 11784 - DNA, 21 bp, Homo Sapiens
  primer_bind 1..21: downstream amplification primer 99-217 for SEQ 3919, in complement
gtttattttgtgtgagctttg

SEQ ID NO: 11785 - DNA, 20 bp, Homo Sapiens
  primer_bind 1..20: downstream amplification primer 4-67 for SEQ 3920, in complement
tgaaagagtttattctctgg

SEQ ID NO: 11786 - DNA, 21 bp, Homo Sapiens
  primer_bind 1..21: downstream amplification primer 99-213 for SEQ 3921, in complement
ttattgccccacatgcttgag

SEQ ID NO: 11787 - DNA, 19 bp, Homo Sapiens
  primer_bind 1..19: downstream amplification primer 99-221 for SEQ 3922, in complement
tcattcgtctggctaggtc

SEQ ID NO: 11788 - DNA, 18 bp, Homo Sapiens
  primer_bind 1..18: downstream amplification primer 99-135 for SEQ 3923, in complement
aaacacctcccattgtgc

SEQ ID NO: 11789 - DNA, 20 bp, Homo Sapiens
  primer_bind 1..20: downstream amplification primer 99-1482 for SEQ 3924, in complement
acaaatctatataaggctgg

SEQ ID NO: 11790 - DNA, 20 bp, Homo Sapiens
  primer_bind 1..20: downstream amplification primer 4-73 for SEQ 3925, in complement
ctcttggttaaacagcagtg

SEQ ID NO: 11791 - DNA, 18 bp, Homo Sapiens
  primer_bind 1..18: downstream amplification primer 4-65 for SEQ 3926, in complement
tggctctgcatttcttcc

SEQ ID NO: 11792 - DNA, 20 bp, Homo Sapiens
  primer_bind 1..20: downstream amplification primer 10-32 for SEQ 3927, in complement
aattgtttaagcctgacttc

SEQ ID NO: 11793 - DNA, 19 bp, Homo Sapiens
  primer_bind 1..19: downstream amplification primer 10-33 for SEQ 3928, SEQ 3929, SEQ 3930, in complement
tgttttgacactagcactc

SEQ ID NO: 11794 - DNA, 18 bp, Homo Sapiens
  primer_bind 1..18: downstream amplification primer 10-35 for SEQ 3931, SEQ 3932, in complement
agctgtattttcagagcc

SEQ ID NO: 11795 - DNA, 20 bp, Homo Sapiens
  primer_bind 1..20: downstream amplification primer 10-36 for SEQ 3933, in complement
gctgacatgacatcattttg

SEQ ID NO: 11796 - DNA, 18 bp, Homo Sapiens
  primer_bind 1..18: downstream amplification primer 10-204 for SEQ 3934, in complement
tcccaccaggagaagcag

What is claimed is:

1. A method of determining whether an individual is at an increased risk for developing Alzheimer's disease comprising:
   (a) obtaining a biological sample comprising a nucleic acid from said individual;
   (b) determining the identity of a biallelic marker at position 24 of SEQ ID NO: 3913 within said biological sample;
   (c) evaluating whether an individual is at increased risk of Alzheimer's disease;
   wherein the presence of a T at position 24 of SEQ ID NO: 3913 is indicative of an increased risk to Alzheimer's disease.

2. A method according to claim 1, wherein the identity of the nucleotides at said biallelic marker is determined for both copies of said biallelic marker present in said subject's genome.

3. A method according to claim 1, further comprising amplifying a portion of said sequence comprising the biallelic marker prior to said determining step.

4. A method according to claim 3, wherein said amplifying is performed by PCR.

5. A method according to claim 3, wherein said determining is performed by a hybridization assay, a sequencing assay, a microsequencing assay, or an enzyme-based mismatch detection assay.

* * * * *

UNITED STATES PATENT AND TRADEMARK OFFICE
CERTIFICATE OF CORRECTION

PATENT NO. : 6,537,751 B1
DATED : March 25, 2003
INVENTOR(S) : Daniel Cohen, Ilya Chumakov and Marta Blumenfeld It is certified that error appears in the above-identified patent and that said Letters Patent is hereby corrected as shown below:

Column 15,
Line 56, "Markers Polynucleotides" should read -- Markers
                                                   Polynucleotides --.

Column 32,
Line 11, "ddNTT's" should read -- ddNTPs --.
Line 13, "(such asp-nitrophenyl" should read -- (such as $p$-nitrophenyl --.

Column 46,
Line 56, "phenotypes" should read -- phenotype $j$ --.

Column 47,
Line 55, "$\theta 4=$—"should read -- $\theta 4 = - - $ --.
Line 57, "$\theta 3=-+$" should read -- $\theta 3 = - + $ --.
Line 59, "$\theta 2=-+$" should read -- $\theta 2 = + - $ --.

Column 48,
Line 32, "with $D_{aiaj}<0$" should read -- with $D_{aiaj}>0$ --.

Column 74,
Line 59, "For % example," should read -- For example, --.

Column 91,
Lines 44-45, "p value<2" should read -- p value $\leq 2$ --.

Column 92,
Line 8, "99-36S-344" should read -- 99-365-344 --.

Column 98,
Line 11, "$5^{E-}03$" should read -- $5^{E}$-03 --.
Line 44, "dNTms" should read -- dNTPs --.

Column 100,
Line 55, "$_{10}$ mM" should read -- 10 mM --.

Column 101,
Line 62, "Markers Sequencing" should read -- "Sequencing"-- should be on a new line.

Columns 103-104,
Table 7, "Haplotype 1    should read    -- Haplotype 1
        5                                  Haplotype 2 --
          Haplotype 2"

UNITED STATES PATENT AND TRADEMARK OFFICE
CERTIFICATE OF CORRECTION

PATENT NO. : 6,537,751 B1
DATED : March 25, 2003
INVENTOR(S) : Daniel Cohen, Ilya Chumakov and Marta Blumenfeld It is certified that error appears in the above-identified patent and that said Letters Patent is hereby corrected as shown below:

<u>Column 104,</u>
Lines 46-47, "Hawley Ma.," should read -- Hawley ME, --.

<u>Column 108,</u>
Sequence ID No 115, "99-12925487" should read -- 99-12925-487 --.

<u>Column 115,</u>
Sequence ID No 623, "99-1582430" should read -- 99-1582-430 --.

<u>Column 116,</u>
Sequence ID No 728, $2^{nd}$ Allele, "j" should read -- T --.

<u>Column 125,</u>
Sequence ID No 1392, "99-2351045" should read -- 99-23510-45 --.

<u>Column 127,</u>
Sequence ID No 1551, "994618-240" should read -- 99-4618-240 --.

<u>Column 128,</u>
Sequence ID No 1579, "994823-173" should read -- 99-4823-173 --.
Sequence ID No 1616, "99-5162461" should read -- 99-5162-461 --.

<u>Column 132,</u>
Sequence ID No 1893, $2^{nd}$ allele, "j" should read -- T --.

<u>Column 137,</u>
Sequence ID No 2284, "99-10155423" should read -- 99-10155-423 --.

<u>Column 140,</u>
Sequence ID No 2446, "99-1J051-154" should read -- 99-11051-154 --.
Sequence ID No 2458, primer, "8" should read -- S --.
Sequence ID No 2493, primer, "8" should read -- S --.

<u>Column 141,</u>
Sequence ID No 2524, primer, "8" should read -- S --.

<u>Column 142,</u>
Sequence ID No 2653, primer, "8" should read -- S --.

<u>Column 145,</u>
Sequence ID No 2834, $2^{nd}$ allele, "j" should read -- T --.

UNITED STATES PATENT AND TRADEMARK OFFICE
CERTIFICATE OF CORRECTION

PATENT NO. : 6,537,751 B1
DATED : March 25, 2003
INVENTOR(S) : Daniel Cohen, Ilya Chumakov and Marta Blumenfeld It is certified that error appears in the above-identified patent and that said Letters Patent is hereby corrected as shown below:

<u>Column 154,</u>
Sequence ID No 3501, "994649-251" should read -- 99-4649-251 --.

<u>Column 159,</u>
Sequence ID No 3885, "994762-114" should read -- 99-4762-114 --.

<u>Column 160,</u>
Table 9, Sequence ID No 2, line 2, "SRGC" should read -- SHGC --.

<u>Columns 161-162,</u>
Sequence ID No 242, last line, "R44970" should read -- R44970/ --.
Sequence ID No 245, line 5, "RR49984" should read -- RH49984 --.

<u>Columns 163-164,</u>
Sequence ID No 332, line 1, "/D25126" should read -- /D2S126 --.
Sequence ID No 497, line 2, "/RR63907/" should read -- /RH63907/ --.
Sequence ID Nos 499 and 503, line 1, "/D252336" should read -- /D2S2336 --.
Sequence ID Nos 507, 508, 509 and 510, "/D25309/" should read -- /D2S309/ --.

<u>Column 167-168,</u>
Sequence ID No 629, marker name, "9-1590-116" should read -- 9-15910-116 --.
Sequence ID No 645, line 8, "AFMa24Swd5" should read -- AFMa245wd5 --.

<u>Columns 171-172,</u>
Sequence ID No 1031, line 2, "D452603" should read -- D4S2603 --.
Sequence ID No 1104, line 2, "/SRGC4-" should read -- /SHGC4- --.

<u>Columns 173-174,</u>
Sequence ID No 1107, line 2, "/SRGC4-" should read -- /SHGC4 --.
Sequence ID No 1235, "/AFM119xb12/" should read -- /AFM119xh12/ --.

<u>Columns 175-176,</u>
Sequence ID No 1304, line 2, "/AFM320Xh1/" should read -- /AFM320xh1/ --.
Sequence ID No 1305, line 1, "/SHGC12090/" should read -- /SHGC-2090/ --.
Sequence ID No 1367, line 1, "/D95921/" should read -- /D9S921 --.

<u>Columns 177 -178,</u>
Sequence ID No 1394, line 1, "/AFMb3S6wg1/" should read -- /AFMb356wg1/ --.

UNITED STATES PATENT AND TRADEMARK OFFICE
CERTIFICATE OF CORRECTION

PATENT NO.    : 6,537,751 B1
DATED         : March 25, 2003
INVENTOR(S)   : Daniel Cohen, Ilya Chumakov and Marta Blumenfeld It is certified that error appears in the above-identified patent and that said Letters Patent is hereby corrected as shown below:

Column 179-180,
Sequence ID No 1433, (lines 2 and 3 omitted), should read -- G27696 / 625597 / EST91724 g27725 / SHGC-942 / Z16981 / RH49039 --.
Sequence ID No 1443, (line 2 omitted), should read -- g27270 / SHGC-3645 / Z17001 / RH13384/ --.

Columns 181-182,
Sequence ID No 1482, line 1, "/CHLC.GATA84D10/" should read -- /CHLC.GATA85D10 --.
Sequence ID No 1633, line 1, "/AFMa28Szb9/" should read -- /AFMa285zb9/ --.

Columns 185-186,
Sequence ID No 1784 line 2, "/SHGC3659/" should read -- SHGC-3659 --.
Sequence ID No 1881, line 1, "/Dl1S5924/" should read -- D11S924 --.
Sequence ID No 1886, marker name, "9-719-278" should read -- 9-7119-278 --.
Sequence ID No 1892, "/HSC2SC022/" should read -- /HSC25CO22/ --.
Sequence 1D No 1905, line 1, "/WI-112357/" should read -- WI-12357/ --.
Sequence ID No 1905, line 2, "/AFMb318z19/" should read -- /AFMb318zf9/ --.
Sequence ID Nos 1962 and 1963, "/AFMb004z19/" should read -- /AFMb004zf9/ --.

Columns 187-188,
Sequence ID No 2033, line 3, "15p13-q12;" should read -- 15p13-q11.1;1p11-q12; --.

Columns 189-190,
Sequence ID No 2445, line 3, "15p13-q12;" should read -- 15p13-q1 l.l;lp11-q12; --.
Sequence ID No 2675, line 2, "/R1150010/" should read -- /RH50010/ --.
Sequence ID No 2706, Column 3, "5q30.1" should read -- 5q31.1 --.
Sequence ID Nos 2706 and 2707, "/D5S4021" should read -- /D5S402/ --.

Columns 191-192,
Sequence ID No 2774, "/D17S9221" should read -- D17S922/ --.
Sequence ID No 2840, Lines 4-6,
"g2482/AFM240xg3/D5S500                    -- g2482/AFM240xg3/D5S500
245                        should read       g653/WI-12096/T61077/ --.
g653/WI-12096/T61077/"

Columns 193-194,
Sequence ID No 3188, "/EST25131/" should read -- /EST251317/ --.

Columns 195-196,
Sequence ID Nos 3241 and 3243, line 3, "/SRGC-" should read -- SHGC --.

UNITED STATES PATENT AND TRADEMARK OFFICE
CERTIFICATE OF CORRECTION

PATENT NO.    : 6,537,751 B1
DATED         : March 25, 2003
INVENTOR(S)   : Daniel Cohen, Ilya Chumakov and Marta Blumenfeld It is certified that error appears in the above-identified patent and that said Letters Patent is hereby corrected as shown below:

Columns 197-198,
Sequence ID No 3889, line 4, "/T726441" should read -- /T72644/ --.
Sequence ID Nos 233 and 235, Line 2, "/AFM093XGS/" should read -- /AFM093XG5/ --.
Sequence ID No 604, "/D25128/" should read -- /D2S128/ --.

Columns 199-200,
Sequence ID No 1005, "/D25280/" should read -- /D2S280/ --.
Sequence ID No 1196, "/D25318/" should read -- /D2S318/ --.

Columns 201-202,
Sequence ID No 1322, "/AFM289vfS" should read -- /AFM289vf5/ --.
Sequence ID No 1438, line 3, "/AFM317ycS/" should read -- /AFM317yc5/ --.

Columns 203-204,
Sequence ID No 3094, "/D25346" should read -- /D2S346/ --.

Column 214,
Sequence ID No 2495, "99-1381-256" should read -- 99-11381-256 --.

Column 222,
Sequence ID No 3411, "3q12-13" should read -- 13q12-13 --.

Column 225,
Sequence ID No 3757, "6p12.2-p12" should read -- 16p12.2-p12 --.

Signed and Sealed this

Sixteenth Day of December, 2003

JAMES E. ROGAN
*Director of the United States Patent and Trademark Office*